(12) United States Patent
Joung et al.

(10) Patent No.: US 9,752,132 B2
(45) Date of Patent: *Sep. 5, 2017

(54) ENGINEERED CRISPR-CAS9 NUCLEASES WITH ALTERED PAM SPECIFICITY

(71) Applicant: The General Hospital Corporation, Boston, MA (US)

(72) Inventors: J. Keith Joung, Winchester, MA (US); Benjamin Kleinstiver, Medford, MA (US)

(73) Assignee: The General Hospital Corporation, Boston, MA (US)

( * ) Notice: Subject to any disclaimer, the term of this patent is extended or adjusted under 35 U.S.C. 154(b) by 0 days.

This patent is subject to a terminal disclaimer.

(21) Appl. No.: 15/208,461

(22) Filed: Jul. 12, 2016

(65) Prior Publication Data

US 2016/0312199 A1    Oct. 27, 2016

Related U.S. Application Data

(63) Continuation of application No. 15/060,448, filed on Mar. 3, 2016.

(60) Provisional application No. 62/127,634, filed on Mar. 3, 2015, provisional application No. 62/165,517, filed on May 22, 2015, provisional application No. 62/239,737, filed on Oct. 9, 2015, provisional application No. 62/258,402, filed on Nov. 20, 2015.

(51) Int. Cl.
| | |
|---|---|
| *C12N 9/22* | (2006.01) |
| *C12N 15/00* | (2006.01) |
| *C12N 15/10* | (2006.01) |
| *C12N 15/63* | (2006.01) |

(52) U.S. Cl.
CPC .............. *C12N 9/22* (2013.01); *C12N 15/102* (2013.01); *C12N 15/63* (2013.01); *C12Y 301/00* (2013.01); *C07K 2319/71* (2013.01); *C12N 2800/80* (2013.01)

(58) Field of Classification Search
None
See application file for complete search history.

(56) References Cited

U.S. PATENT DOCUMENTS

| | | | |
|---|---|---|---|
| 8,697,359 | B1 | 4/2014 | Zhang |
| 2010/0076057 | A1 | 3/2010 | Sontheimer et al. |
| 2011/0189776 | A1 | 8/2011 | Terns et al. |
| 2011/0223638 | A1 | 9/2011 | Wiedenheft et al. |
| 2013/0130248 | A1 | 5/2013 | Haurwitz et al. |
| 2014/0170753 | A1 | 6/2014 | Zhang |
| 2014/0179006 | A1 | 6/2014 | Zhang |
| 2014/0179770 | A1 | 6/2014 | Zhang et al. |
| 2014/0186843 | A1 | 7/2014 | Zhang et al. |
| 2014/0186919 | A1 | 7/2014 | Zhang et al. |
| 2014/0186958 | A1 | 7/2014 | Zhang et al. |
| 2014/0189896 | A1 | 7/2014 | Zhang et al. |
| 2014/0199767 | A1 | 7/2014 | Barrangou et al. |
| 2014/0201857 | A1 | 7/2014 | Fahrenkrug et al. |
| 2014/0212869 | A1 | 7/2014 | Sampas et al. |
| 2014/0227787 | A1 | 8/2014 | Zhang |
| 2014/0234972 | A1 | 8/2014 | Zhang |
| 2014/0242664 | A1 | 8/2014 | Zhang et al. |
| 2014/0242699 | A1 | 8/2014 | Zhang |
| 2014/0242700 | A1 | 8/2014 | Zhang et al. |
| 2014/0242702 | A1 | 8/2014 | Chen et al. |
| 2014/0248702 | A1 | 9/2014 | Zhang et al. |
| 2014/0256046 | A1 | 9/2014 | Zhang et al. |
| 2014/0271987 | A1 | 9/2014 | Manoury et al. |
| 2014/0273230 | A1 | 9/2014 | Chen et al. |
| 2014/0273231 | A1 | 9/2014 | Zhang et al. |
| 2014/0273232 | A1 | 9/2014 | Zhang et al. |
| 2014/0273234 | A1 | 9/2014 | Zhang et al. |
| 2014/0287938 | A1 | 9/2014 | Zhang et al. |
| 2014/0294773 | A1 | 10/2014 | Brouns et al. |
| 2014/0295556 | A1 | 10/2014 | Joung et al. |
| 2014/0298547 | A1 | 10/2014 | Sastry-Dent et al. |
| 2014/0304853 | A1 | 10/2014 | Ainley et al. |
| 2014/0309487 | A1 | 10/2014 | Lee et al. |
| 2014/0310828 | A1 | 10/2014 | Lee et al. |
| 2014/0310830 | A1 | 10/2014 | Zhang et al. |
| 2014/0315985 | A1 | 10/2014 | May et al. |
| 2014/0335063 | A1 | 11/2014 | Cannon et al. |
| 2014/0335620 | A1 | 11/2014 | Zhang et al. |
| 2014/0349400 | A1 | 11/2014 | Jakimo et al. |
| 2014/0357530 | A1 | 12/2014 | Zhang et al. |
| 2014/0377868 | A1 | 12/2014 | Joung et al. |
| 2015/0024500 | A1 | 1/2015 | Yu et al. |
| 2015/0031134 | A1 | 1/2015 | Zhang et al. |
| 2015/0045546 | A1 | 2/2015 | Silksnys et al. |

(Continued)

FOREIGN PATENT DOCUMENTS

| | | |
|---|---|---|
| WO | WO/2008/108989 | 9/2008 |
| WO | WO/2010/054108 | 5/2010 |
| WO | WO/2012/164565 | 12/2012 |

(Continued)

OTHER PUBLICATIONS

UniProt Database Accession No. U5ULJ7, Feb. 2014, 2 pages.*
U.S. Appl. No. 61/652,086, filed May 25, 2012, Jinek et al.
Al-Attar et al., "Clustered regularly interspaced short palindromic repeats (CRISPRs): the hallmark of an ingenious antiviral defense mechanism in prokaryotes," Biol Chem., Apr. 2011, 392:277-289.
Anders et al., "4un3: Crystal structure of Cas9 bound to PAM-containing DNA target," RCSB Protein Data Bank, May 25, 2014, retrieved on May 6, 2016, http://www.rcsb.org/pdb/explore/explore.do?structureId=4U, 3 pages.

(Continued)

*Primary Examiner* — David J Steadman
(74) *Attorney, Agent, or Firm* — Fish & Richardson P.C.

(57) ABSTRACT

Engineered CRISPR-Cas9 nucleases with altered and improved PAM specificities and their use in genomic engineering, epigenomic engineering, and genome targeting.

24 Claims, 54 Drawing Sheets
(49 of 54 Drawing Sheet(s) Filed in Color)

(56) References Cited

U.S. PATENT DOCUMENTS

2015/0050699 A1     2/2015   Silksnys et al.

FOREIGN PATENT DOCUMENTS

| WO | WO/2013/098244 | 7/2013 |
|----|----------------|--------|
| WO | WO/2013/176772 | 11/2013 |
| WO | WO 2014/124284 | 8/2014 |
| WO | WO 2014/152432 | 9/2014 |

OTHER PUBLICATIONS

Anders et al., "Structural basis of PAM-dependent target DNA recognition by the Cas9 endonuclease," Nature, 2014, 513:569-573.

Barrangou & May, "Unraveling the potential of CRISPR-Cas9 for gene therapy," Expert Opin. Biol. Ther., 2015, 15:311-314.

Canver et al., "BCL11A enhancer dissection by Cas9-mediated in situ saturating mutagenesis," Nature., Nov. 15, 2015, 527(7577), 192-7.

Carroll, "A CRISPR Approach to Gene Targeting," Molecular Therapy, 2012, 20(9):1658-1660.

Chen & Zhao, "A highly sensitive selection method for directed evolution of homing endonucleases," Nucleic Acids Res., 2005, 33(18):e154.

Chylinski et al., "The tracrRNA and Cas9 families of type II CRISPR-Cas immunity systems," RNA Biol., 2013, 10(5):726-737.

Cong et al., "Multiplex genome engineering using CRISPR/Cas systems," Science, 2013, 339:819-823 (Author Manuscript).

Courtney et al., "CRISPR/Cas9 DNA cleavage at SNP-derived PAM enables both in vitro and in vivo KRT12 mutation-specific targeting," Gene Ther., 2016, 23(1):108-12.

Deltcheva et al., "CRISPR RNA maturation by trans-encoded small RNA and host factor Rnase III," Nature, 2011, 471(7340):602-607 (Author Manuscript).

Deveau et al., "Phage response to CRISPR-encoded resistance in *Streptococcus thermophilus*," J Bacteriol., Feb. 2008, 190(4):1390-400.

Doudna and Charpentier, "Genome editing. The new frontier of genome engineering with CRISPR-Cas9," Science, Nov. 2014, 346:1258096, 11 pages.

Doyon et al., "Directed Evolution and Substrate Specificity Profile of Homing Endonuclease I-Scel," J. Am. Chem. Soc., 2006, 128:2477-2484.

Esvelt et al., "Orthogonal Cas9 proteins for RNA-guided gene regulation and editing," Nat Methods, Nov. 2013, 10(11):1116-21.

Fonfara et al., "Phylogeny of Cas9 determines functional exchangeability of dual-RNA and Cas9 among orthologous type II CRISPR-Cas systems." Nucleic Acids Res., Feb. 2014, 42(4):2577-90.

Fu et al., "High-frequency off-target mutagenesis induced by CRISPR-Cas nucleases in human cells," Nat Biotechnol., 2013, 31:822-826 (Author Manuscript).

Fu et al., "Improving CRISPR-Cas nuclease specificity using truncated guide RNAs," Nat. Biotechnol. Mar. 2014, 32:279-284.

Gagnon et al., "Efficient mutagenesis by Cas9 protein-mediated oligonucleotide insertion and large-scale assessment of single-guide RNAs," PLoS One, May 2014, 9, e98186.

Gasiunas,"Cas9-crRNA ribonucleoprotein complex mediates specific DNA cleavage for adaptive immunity in bacteria," Proc Natl Acad Sci U S A, Sep. 25, 2012, 109(39):E2579-86.

Guilinger et al., "Fusion of catalytically inactive Cas9 to FokI nuclease improves the specificity of genome modification," Nat Biotechnol., Apr. 2014, 32(6):577-583.

Hale et al., "Essential features and rational design of CRISPR RNAs that function with the Case RAMP modlule complex to cleave RNAs," Mol Cell., 2012, 45(3):292-302 (Author Manuscript).

Horvath et al., "Diversity, activity, and evolution of CRISPR loci in *Streptococcus thermophilus*," J. Bacteriol., Feb. 2008, 190:1401-1412.

Hou et al., "Efficient genome engineering in human pluripotent stem cells using Cas9 from Neisseria meningitidis," Proc Natl Acad Sci U S A, Sep. 24, 2013, 110(39):15644-9.

Hsu et al., "Development and Applications of CRISPR-Cas9 for Genome Engineering," Cell, 2014, 157(6):1262-1278.

Hsu et al., "DNA targeting specificity of RNA-guided Cas9 nucleases," Nat Biotechnol., 2013, 31:827-832.

Hwang et al., "Efficient In Vivo Genome Editing Using RNA-Guided Nucleases," Nat Biotechnol., 2013, 31:227-229 (Author Manuscript).

International Search Report and Written Opinion in International Application No. PCT/US16/20756, dated Jul. 26, 2016, 12 pages.

Iyer et al., "Prediction of novel families of enzymes involved in oxidative and other complex modifications of bases in nucleic acids," Cell Cycle, Jun. 1, 2009, 8(11):1698-710.

Jiang et al., "CRISPR-assisted editing of bacterial genomes," Nat Biotechnol., 2013, 31:233-239 (Author Manuscript).

Jiang et al., "Structural Biology. A Cas9-guide RNA complex preorganized for target DNA recognition," Science, Jun. 2015, 348:1477-1481.

Jinek et al., "A programmable dual-RNA-guided DNA endonuclease in adaptive bacterial immunity," Science, 2012, 337:816-821.

Jinek et al., "RNA-programmed genome editing in human cells," Elife, 2013, 2:e00471, 9 pages.

Kleinstiver el al., "Broadening the targeting range of *Staphylococcus aureus* CRISPR-Cas9 by modifying PAM recognition," Nature Biotechnology, Dec. 2015, 33(12): 1293-1298.

Kleinstiver et al., "A unified genetic, computational and experimental framework identifies functionally relevant residues of the homing endonuclease I-BmoI," Nucleic Acids Res., 2010, 38:2411-2427.

Kleinstiver et al., "Engineered CRISPR-Cas9 nucleases with altered PAM specificities," Nature, Jul. 23, 2015, 523(7561): 481-485.

Lin et al., "CRISPR/Cas9 systems have off-target activity with insertions or deletions between target DNA and guide RNA sequences," Nucleic Acids Res., 2014, 42:7473-7485.

Makarova et al., "Evolution and classification of the CRISPR-Cas systems," Nat. Rev. Microbiol., 2011, 9(6):467-77 (Author Manuscript).

Mali et al., "CAS9 transcriptional activators for target specificity screening and paired nickases for cooperative genome engineering," Nat Biotechnol., 2013, 31:833-838.

Mali et al., "RNA-guided human genome engineering via Cas9," Science, Feb. 2013, 339:823-826 (Author Manuscript).

Mojica et al., "Short motif sequences determine the targets of the prokaryotic CRISPR defense system," Microbiology, 2009, 155:733-740.

Nishimasu et al., "Crystal structure of Cas9 in complex with guide RNA and target DNA," Cell, 2014, 156:935-949.

Ran et al., "Double nicking by RNA-guided CRISPR Cas9 for enhanced genome editing specificity," Cell, 2013, 154:1380-1389.

Ran et al., "In vivo genome editing using *Staphylococcus aureus* Cas9," Nature, 2015, 520:186-191.

Reyon et al., "FLASH assembly of TALENs for high-throughput genome editing," Nat Biotech, 2012, 30:460-465 (Author Manuscript).

Sander and Joung et al., "CRISPR-Cas systems for editing, regulating and targeting genomes," Nat Biotechnol., Apr. 2014, 32(4):347-55.

Sapranauskas et al., "The *Streptococcus thermophilus* CRISPR/Cas system provides immunity in *Escherichia coli*," Nucleic Acids Res., 2011, 39(21):9275-9282.

Shah et al., "Protospacer recognition motifs," RNA Biol., 2013, 10:891-899.

Sternberg et al., "DNA interrogation by the CRISPR RNA-guided endonuclease Cas9," Nature, 2014, 507:62-67.

Tsai et al., "Dimeric CRISPR RNA-guided FokI nucleases for highly specific genome editing," Nat Biotechnol., Apr. 2014, 32(6):569-576.

Tsai et al., "GUIDE-Seq enables genome-wide profiling of off-target cleavage by CRISPR-Cas nucleases," Nat Biotechnol, Feb. 2015, 33:187-197.

(56) References Cited

OTHER PUBLICATIONS

Vierstra et al., "Functional footprinting of regulatory DNA," Nature Methods, Mar. 25, 2015, 12(10):927-30.
Wiedenheft, "RNA-guided genetic silencing systems in bacteria and archaea," Nature, 2012, 482:331-338.
Zhang et al., "Comparison of non-canonical PAMS for CRISPR/Cas9-mediated DNA cleavage in human cells," Sci Rep, Jun. 23, 2014, 4:5405.
Zhang et al., "Processing-Independent CRISPR RNAs Limit Natural Transformation in Neisseria meningitidis," Mol Cell, May 23, 2013, 50(4): 488-503.

* cited by examiner

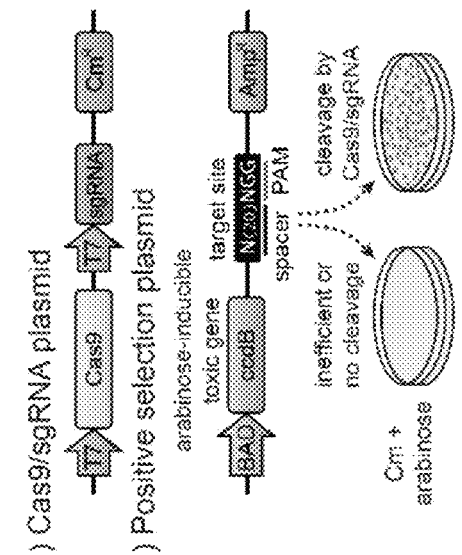
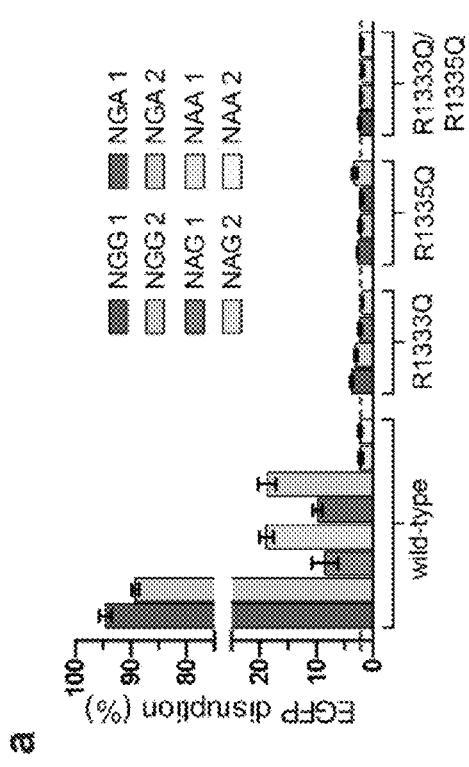
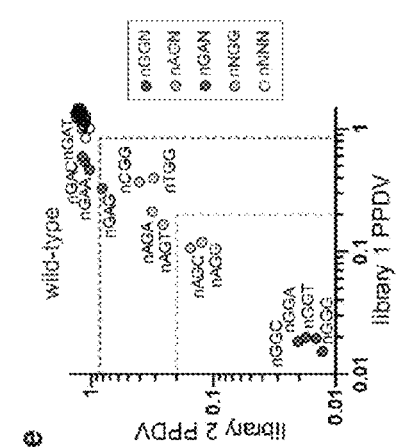
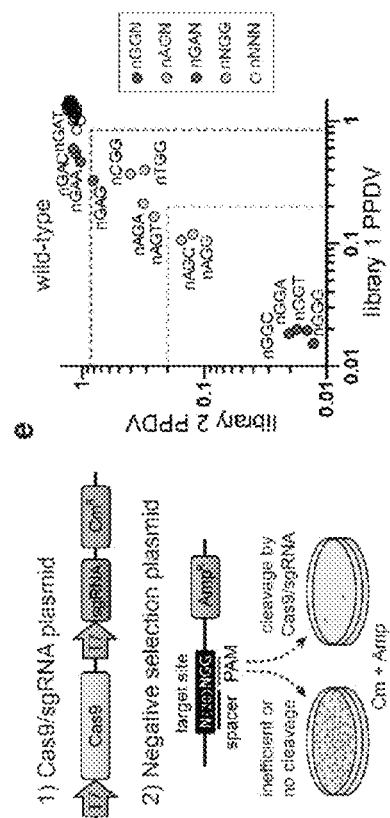
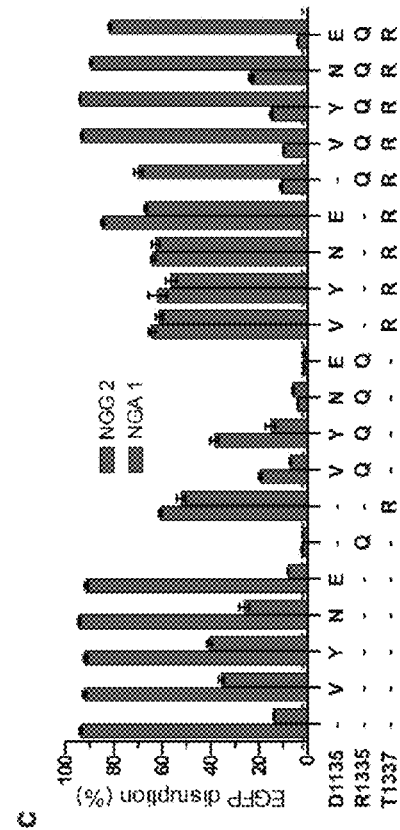
FIG. 1A
FIG. 1B
FIG. 1C
FIG. 1D
FIG. 1E

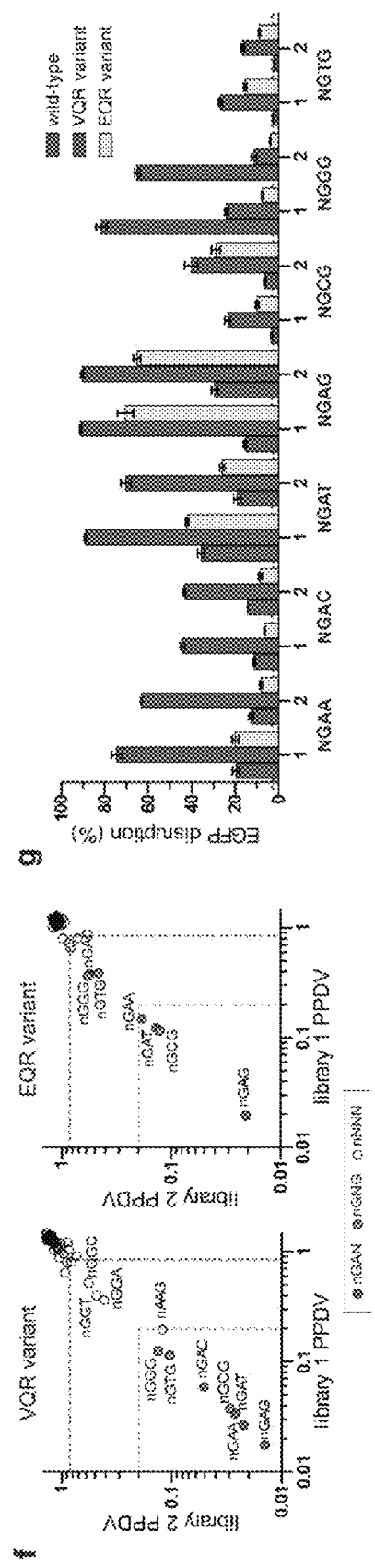
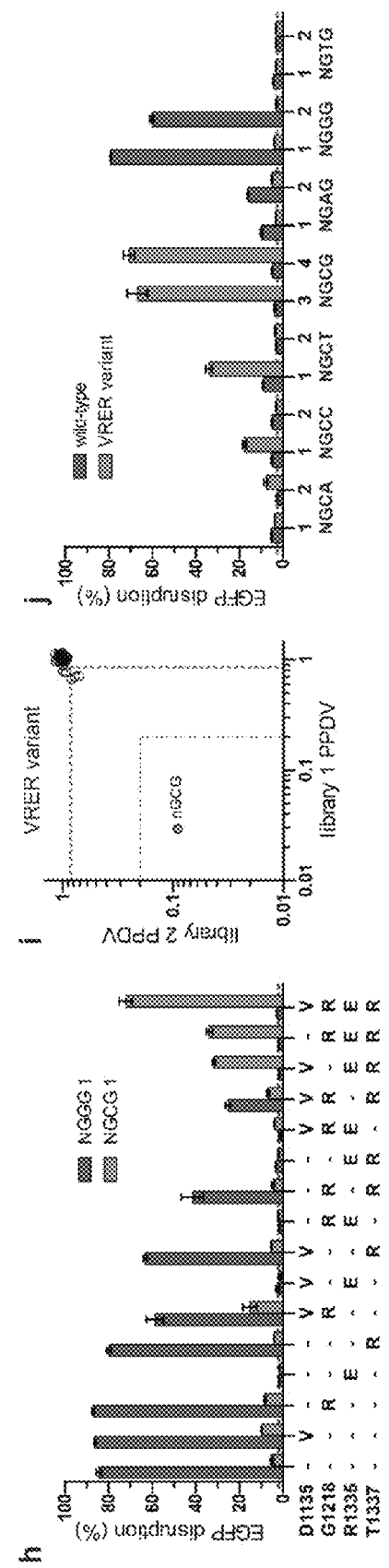
FIG. 1F
FIG. 1G
FIG. 1H
FIG. 1I
FIG. 1J

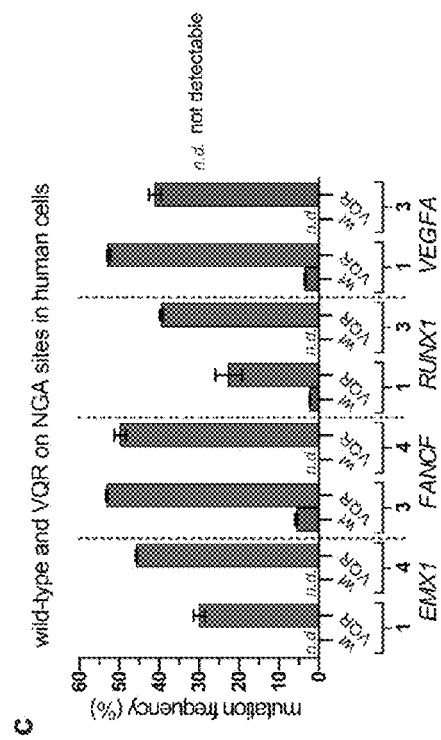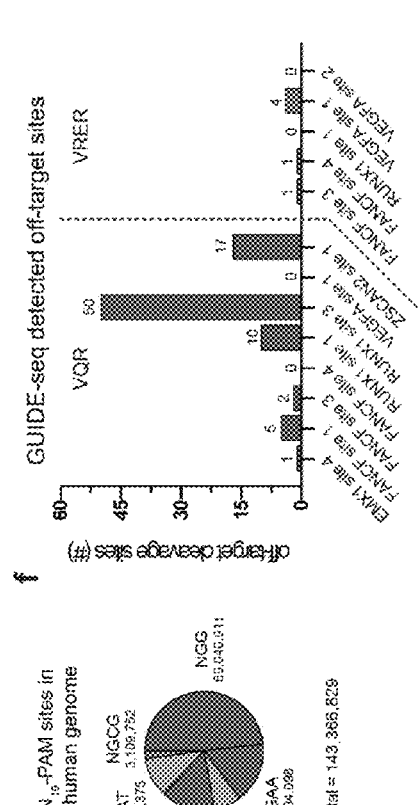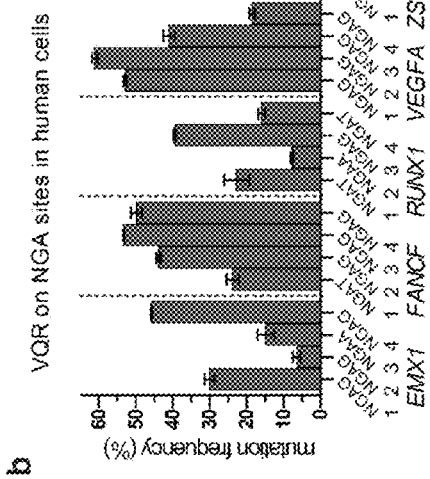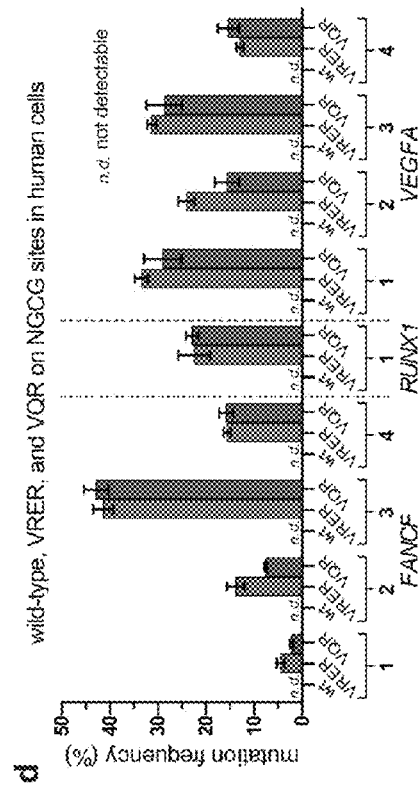
FIG. 2A FIG. 2B FIG. 2C FIG. 2D FIG. 2E FIG. 2F

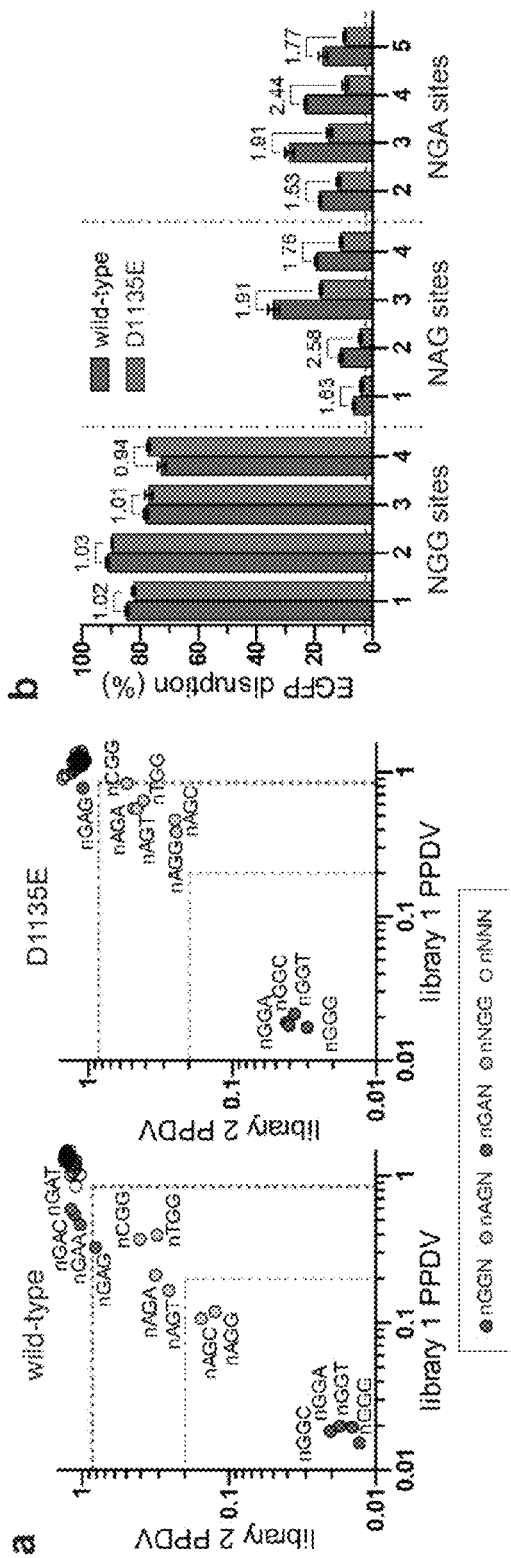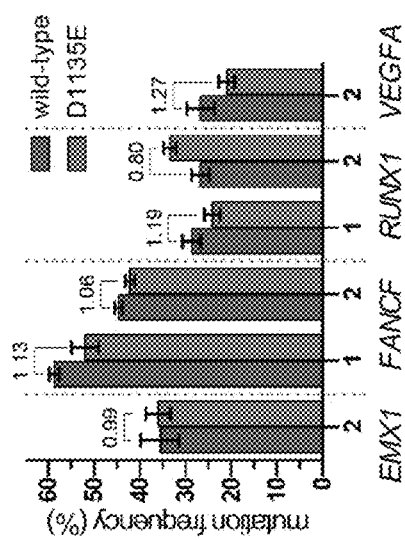
FIG. 3A
FIG. 3B
FIG. 3C

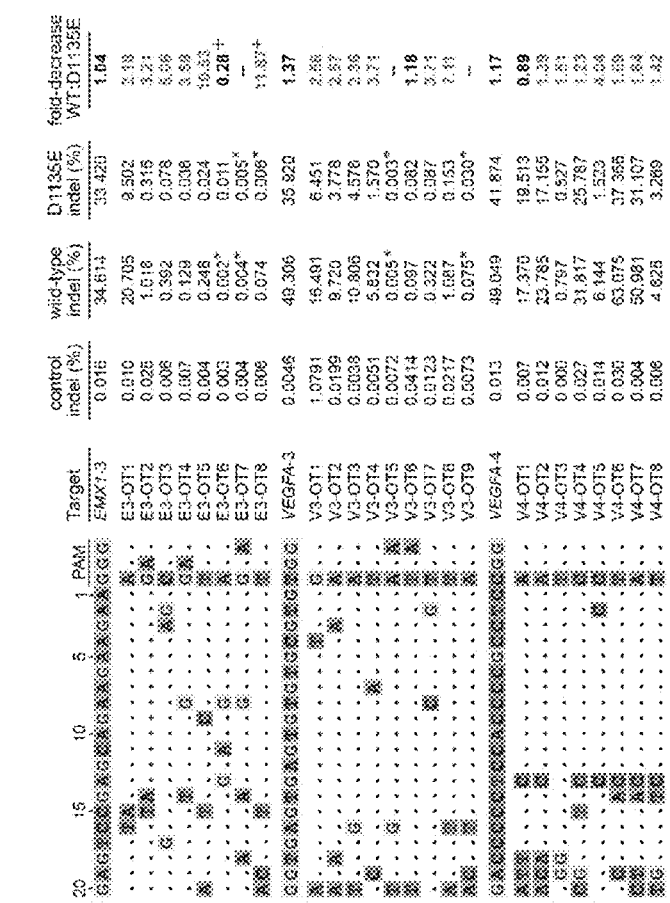
FIG. 3E
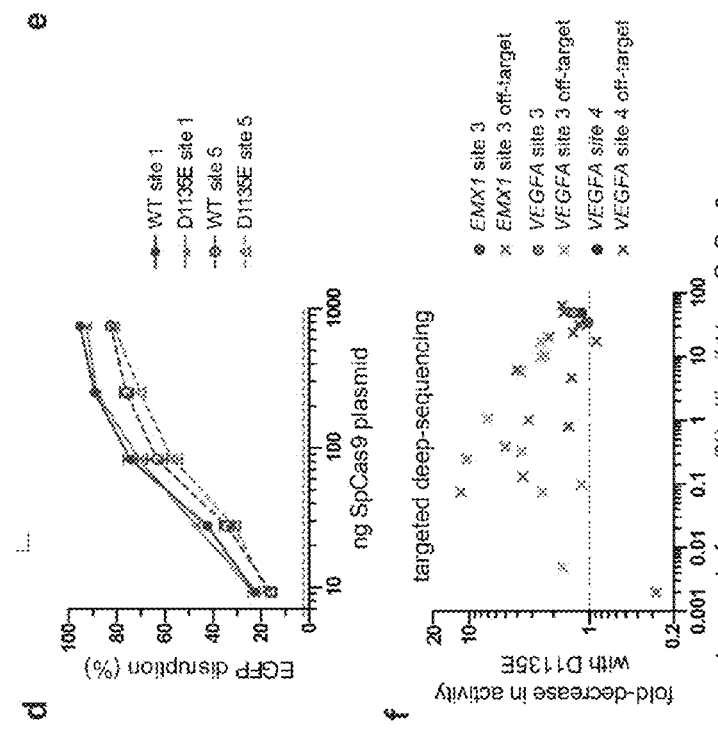
FIG. 3D
FIG. 3F

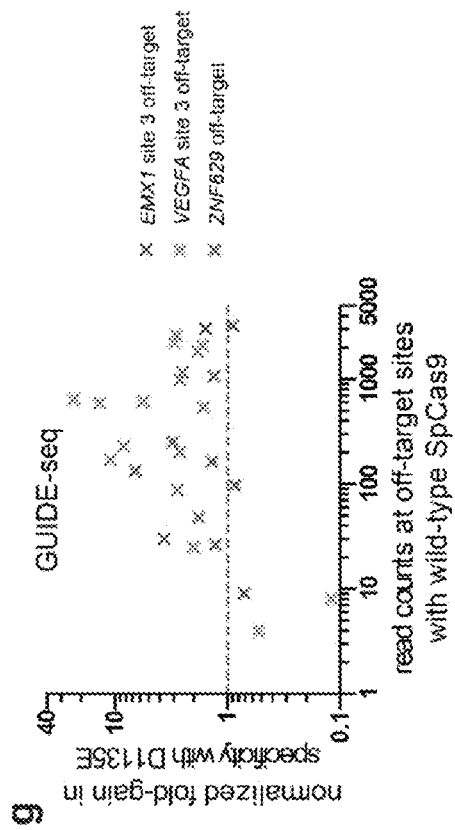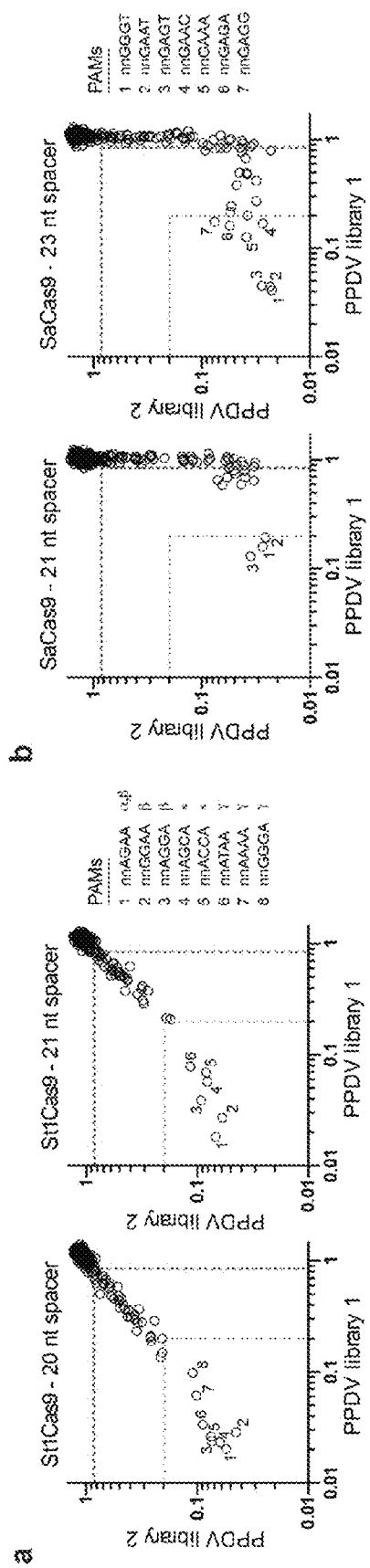

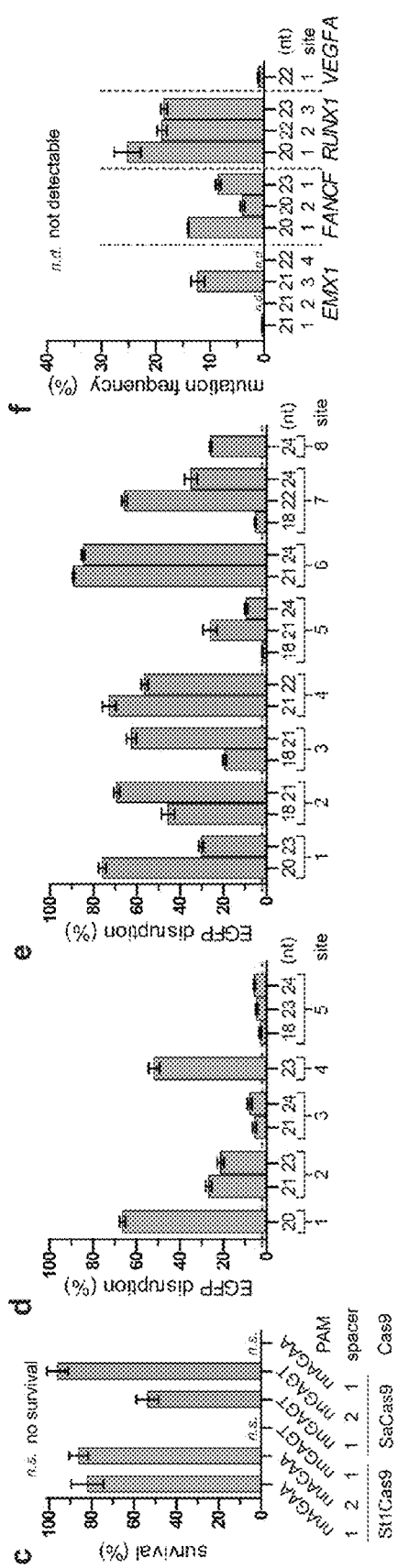

FIG. 8B

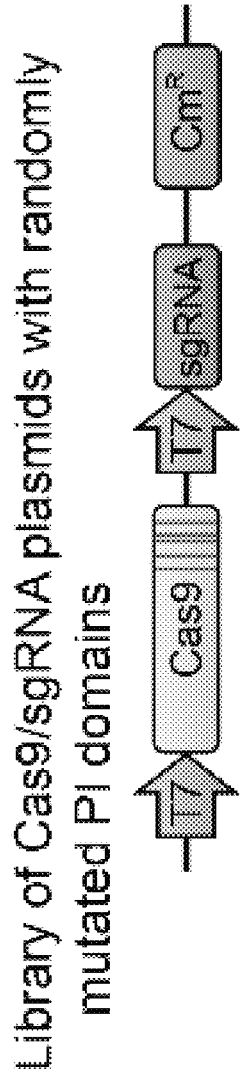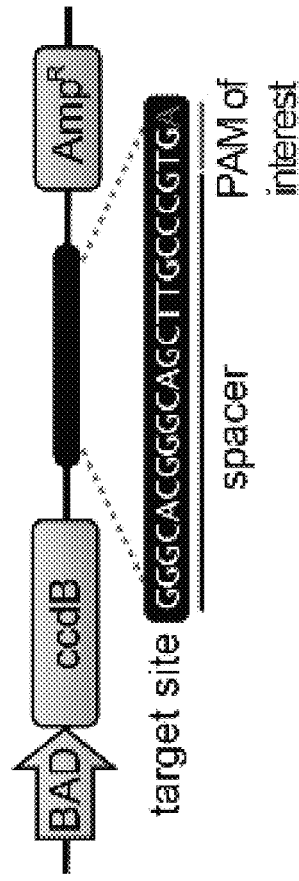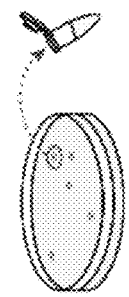
FIG. 12B

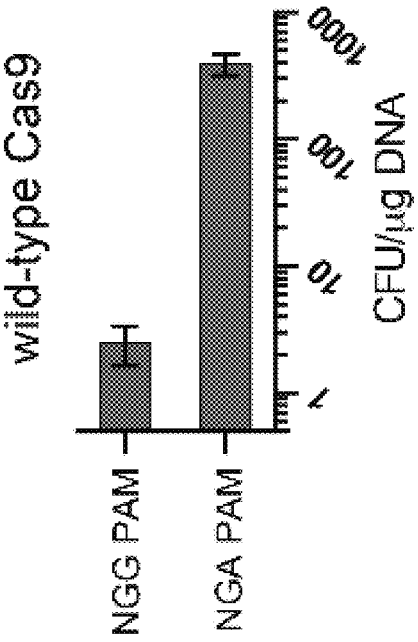
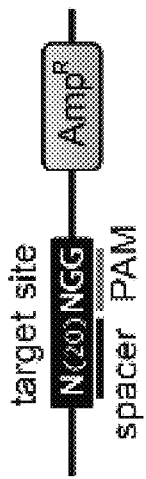
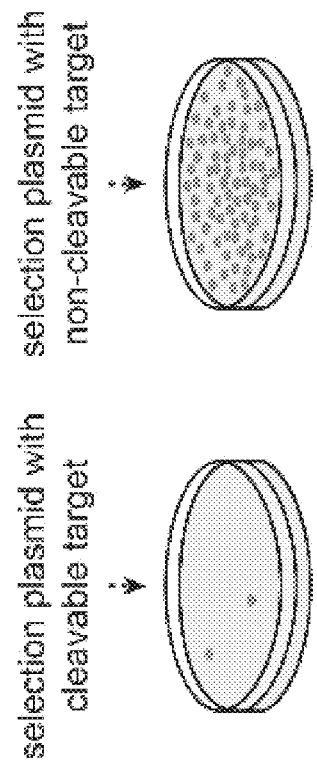
FIG. 13A

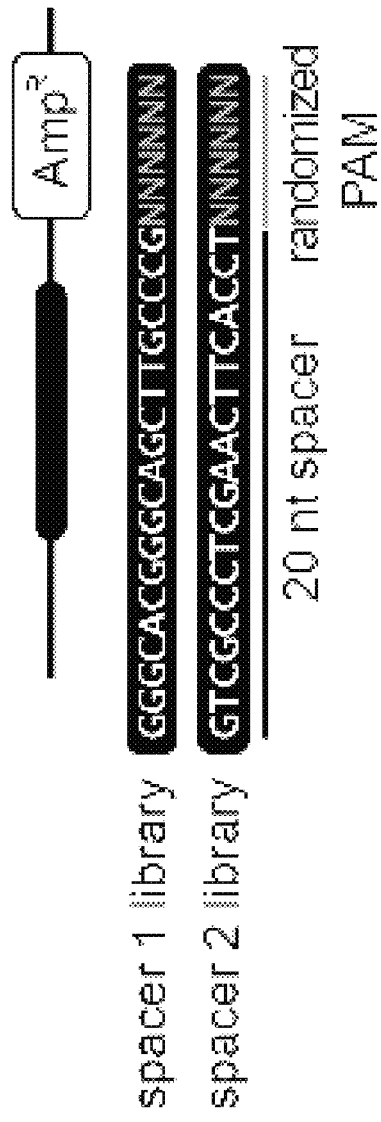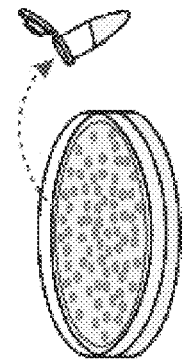
FIG. 13B

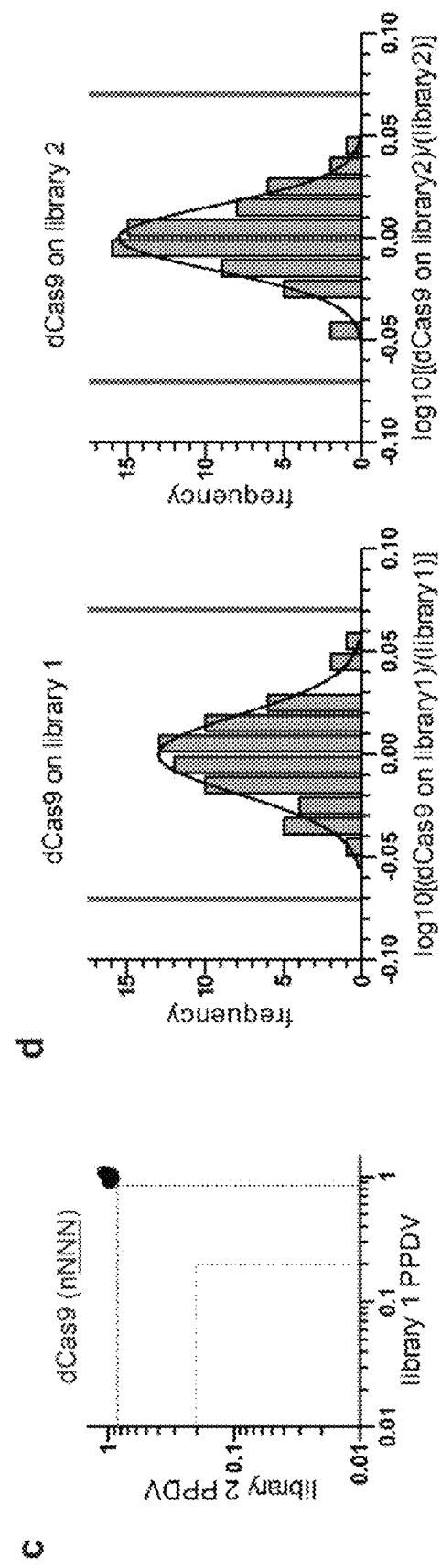
FIGS. 13C-D

| th1 | - Mutations in 15/17 sequences | SEQ ID NO: |
|---|---|---|
| | CGTAAGGAGCGCGAGGCGGCGGCGGCCGCGGCGGGAGGCTGCAGGACTGAGGCGAGCAGATCGTGTTTGAGG Wild-type | 107 |
| | CGTAAGGAGCG------------------------------------------------AGCAGATCGTGTTTGAGG -41 | 108 |
| | CGTAAGGAGCGCGAGG-------------------------------------CGAGCAGATCGTGTTTGAGG -34 | 109 |
| | CGTAAGGAGCGCGAGGC---------------------------------TGAGCGAGATCGTGTTTGAGG -29 | 110 |
| | CGTAAGGAGCGCGAGGCGGC----------------------------GAGCGAGATCGTGTTTGAGG -28 | 111 |
| | CGTAAGGAGCGCGAGGCGGCGGCGGCCGCGGCCCGcagatc------GAGCGAGCAGATCGTGTTTGAGG -16 (-21,+5) | 112 |
| | CGTAAGGAGCGCGAGGCGGCGGCGGCCGCGGGCt-----------------AGCGAGCAGATCGTGTTTGAGG -15 (-16,+1) | 113 |
| | CGTAAGGAGCGCGAGGCGGCGGCGGCCGCGGCCGCGG----------GCGAGCAGATCGTGTTTGAGG -15 | 114 |
| | CGTAAGGAGCGCGAGGCGGCGGCGGCCGCGCGGCGC---------TGAGCGAGCAGATCGTGTTTGAGG -14 | 115 |
| | CGTAAGGAGCGCGAGGCGCagcgagcgcggcg----------------GCGAGCAGATCGTGTTTGAGG -13 (-32,+19) | 116 |
| | CGTAAGGAGCGCGcagagagcgtaaggagcgaggcg---------GCGAGCAGATCGTGTTTGAGG -13 (-37,+24) | 117 |
| | CGTAAGGAGCGCGAGGCGGCGGCGGCCGCGGCGGCGGAGG-----------CTGAGCGAGCAGATCGTGTTTGAGG -8 | 118 |
| | CGTAAGGAGCGCGAGGCGGCGGCGGCCGCGGCGGCGGAGGCTGCAG-ACTGAGCGAGCAGATCGTGTTTGAGG -1 [2x] | 119 |
| | CGTAAGGAGCGCGAGGCGGCGGCGGCCGCGGCGGCGGAGGCTGagcgaGACTGAGCGAGCAGATCGTGTTTGA +2 (-3,+5) | 120 |
| | CGTAAGGAGCGCGAGGCGGCGGCGGCCGCGGCGGCGGAGGCTGCAGcgagcagagcgagcagatcGTGTTTGA +2 (-17,+19) | 121 |

| tia1l | - Mutations in 17/27 sequences | SEQ ID NO: |
|---|---|---|
| | TGTCGGGAACCTCTCCAGGATGTTACGGAGGCCCTCATCCTGCAAGTGTTCTCTCAGATC Wild-type | 122 |
| | TGTCGGGtat----------GTTACGGAGGCCCTCATCCTGCAAGTGTTCTCTCAGATC -12 (-15,+3) | 123 |
| | TGTCGGGAACCTCT---------GTTACGGAGGCCCTCATCCTGCAAGTGTTCTCTCAGATC -8 [X4] | 124 |
| | TGTCGGGAACCTCTCC------TGTTACGGAGGCCCTCATCCTGCAAGTGTTCTCTCAGATC -5 | 125 |
| | TGTCGGGAACCTCTCCA-----TGTTACGGAGGCCCTCATCCTGCAAGTGTTCTCTCAGATC -4 [X3] | 126 |
| | TGTCGGGAACCTCTCC-GGGATGTTACGGAGGCCCTTATCCTGCAAGTGTTCTCTCAGATC -1 | 127 |
| | TGTCGGGAACCTCTCCAt-GATGTTACGGAGGCCCTCATCCTGCAAGTGTTCTCTCAGATC -1 (-2,+1) | 128 |
| | TGTCGGGAACCTCTCCAGGGAcGTTACGGAGGCCCTCATCCTGCAAGTGTTCTCTCAGATC 0 (-1,+1) | 129 |
| | TGTCGGGAACCTCTgaaccGGATGTTACGGAGGCCCTCATCCTGCAAGTGTTCTCTCAGAT +1 (-4,+5) | 130 |
| | TGTCGGGAACCTCTCgttacggaGATGTTACGGAGGCCCTCATCCTGCAAGTGTTCTCTCA +4 (-4,+8) | 131 |
| | TGTCGGGAACCTCTCCAtgttacGGATGTTACGGAGGCCCTCATCCTGCAAGTGTTCTCTC +5 (-1,+6) | 132 |
| | TGTCGGGAACCTCTCCAtgttgtGGATGTTACGGAGGCCCTCATCCTGCAAGTGTTCTCTC +5 (-1,+6) | 133 |
| | TGTCGGGAACCTCTCCAtttgagagggaattatttataaaataaataaTTACGGAGGCCCT +20 (-11,+31) | 134 |

| fh | - Mutations in 6/20 sequences | SEQ ID NO: |
|---|---|---|
| | CATGGCGACCGGCGGGGCGGAACTACTGCTCTCCAACCAGAGGCGAGAATCGGGGGCGGGGACG wild-type | 135 |
| | CATGGCGACCGGCGGGGCGGAACTACTGC------ACCAGAGGCGAGAATCGGGGGCGGGGACG -6 | 136 |
| | CATGGCGACCGGCGGGGCGGAACTACTGCTCT-----CAGAGGCGAGAATCGGGGGCGGGGACG -5 | 137 |
| | CATGGCGACCGGCGGGGCGGAACTACTGCTCT-----CCAGAGGCGAGAATCGGGGGCGGGGACG -4 | 138 |
| | CATGGCGACCGGCGGGGCGGAACTACTGCTCg------CCAGAGGCGAGAATCGGGGGCGGGGACG -4 (-5,+1) | 139 |
| | CATGGCGACCGGCGGGGCGGAACTACTGCTCTCcagaggCCAGAGGCCAGAGGCGAGAATCGGGGGCGG +3 (-3,+6) | 140 |
| | CATGGCGACCGGCGGGGCGGAGCTACTGCTCTGCTCTCtactgctctctcACCAGAGGCGAGAATCGG +10 (-2,+12) | 141 |

FIG. 15

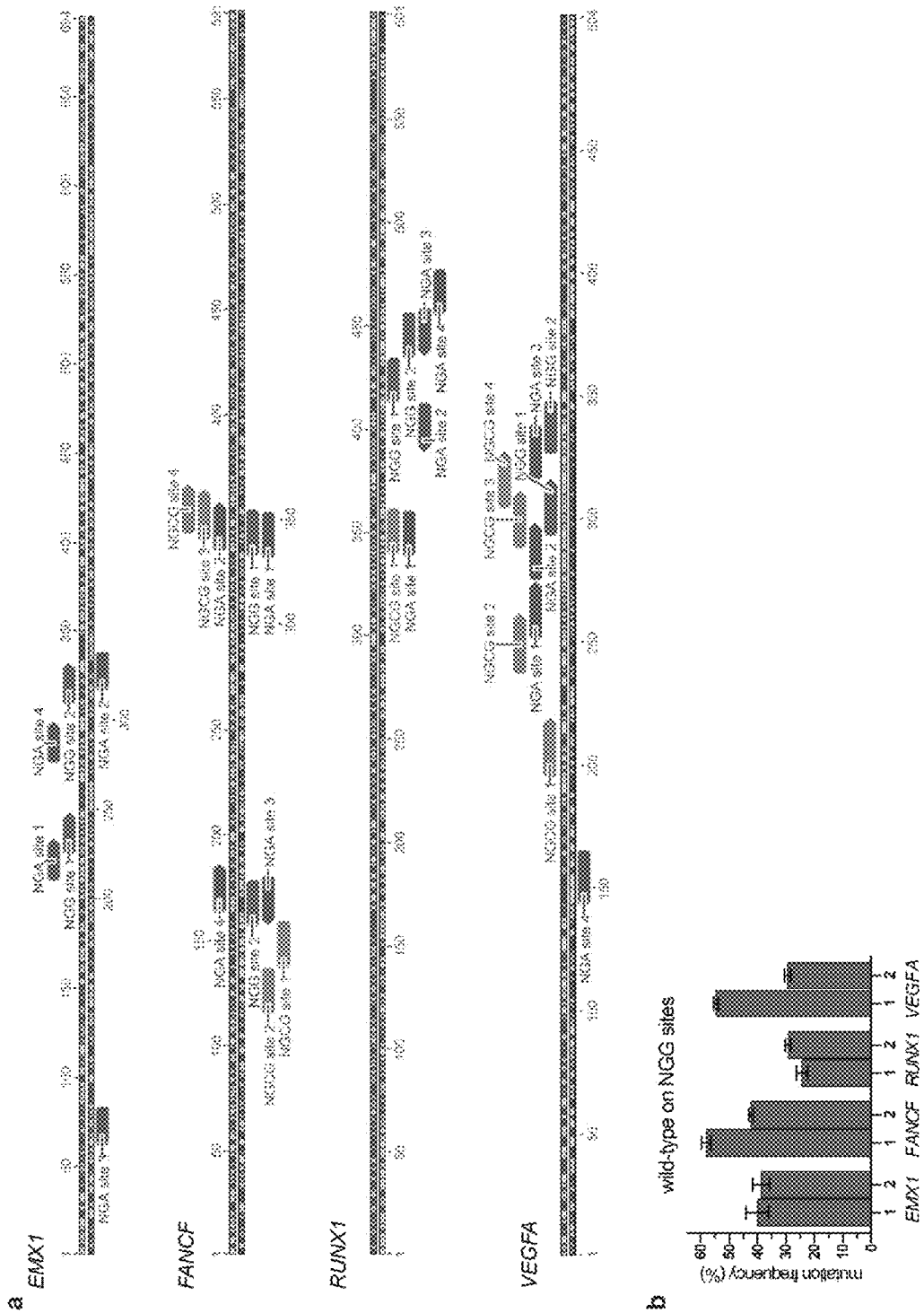
FIGS. 16A-B

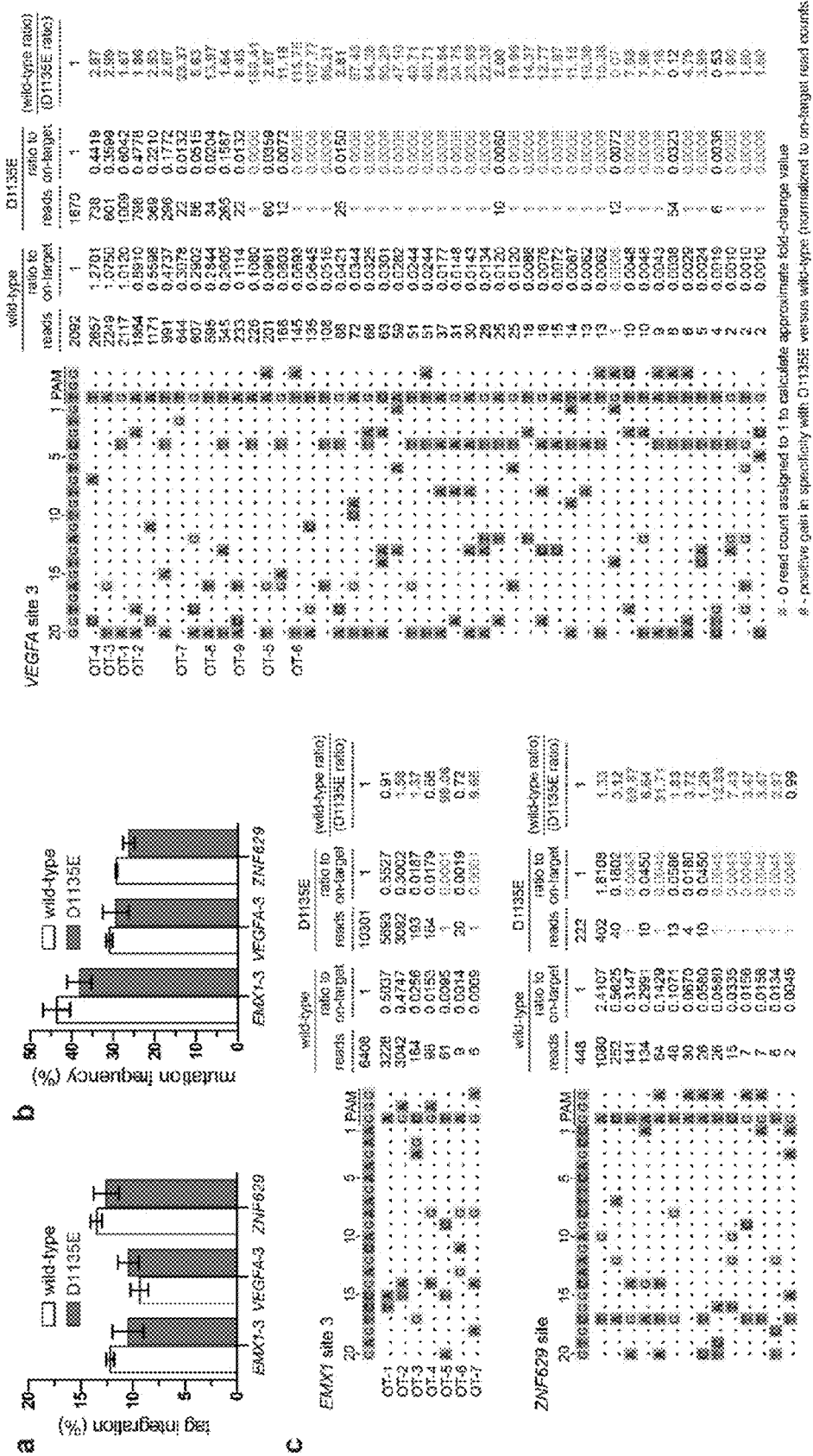
FIGS. 18A-C

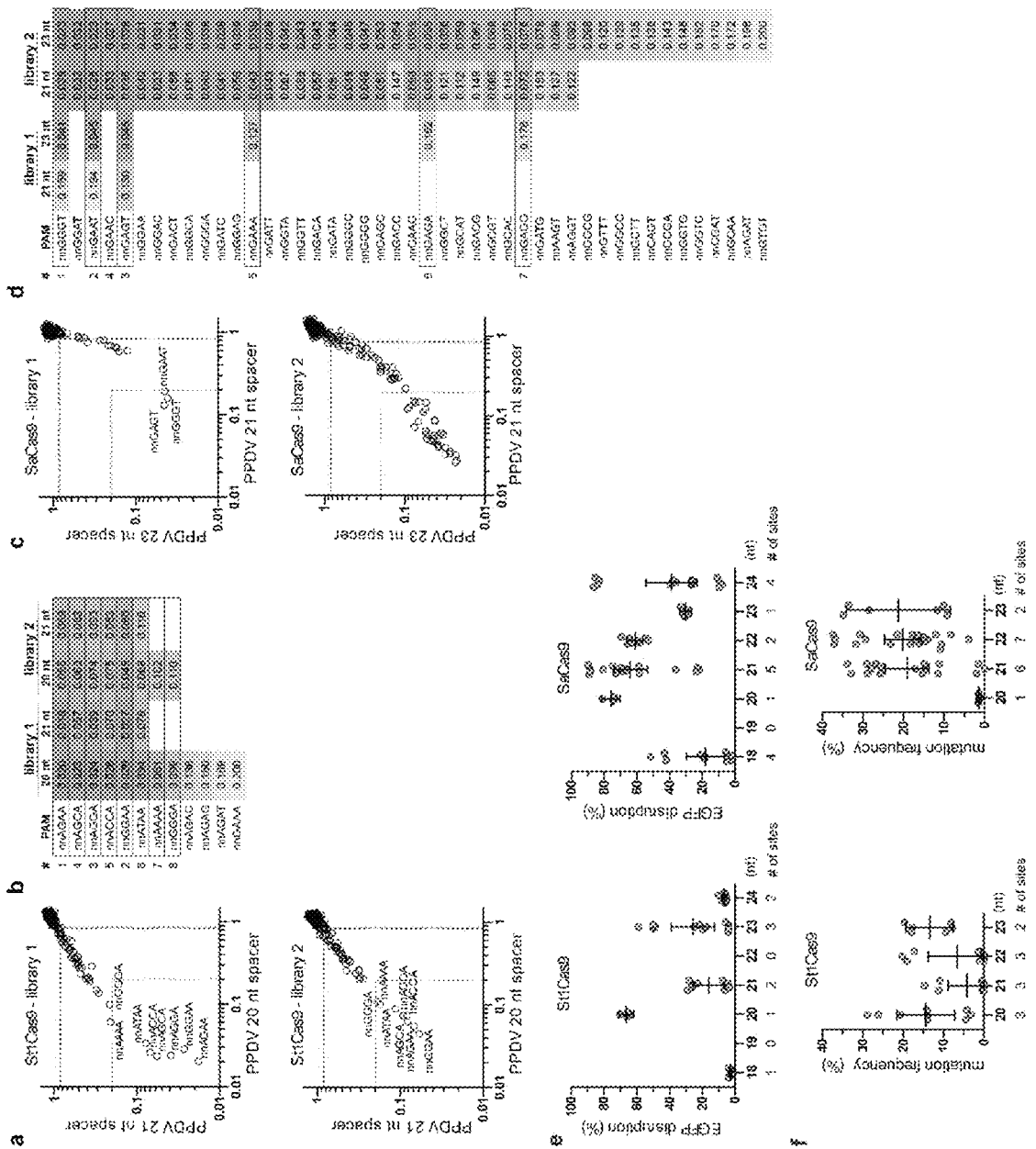
FIGS. 19A-F

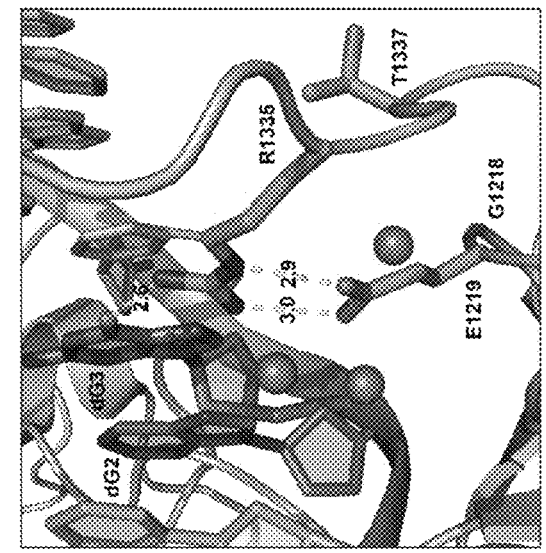
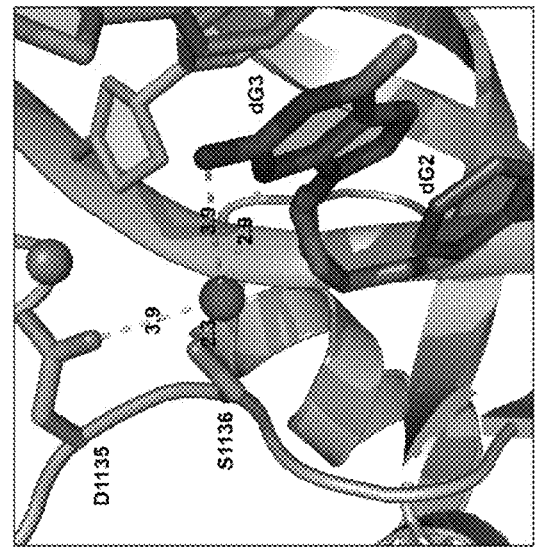
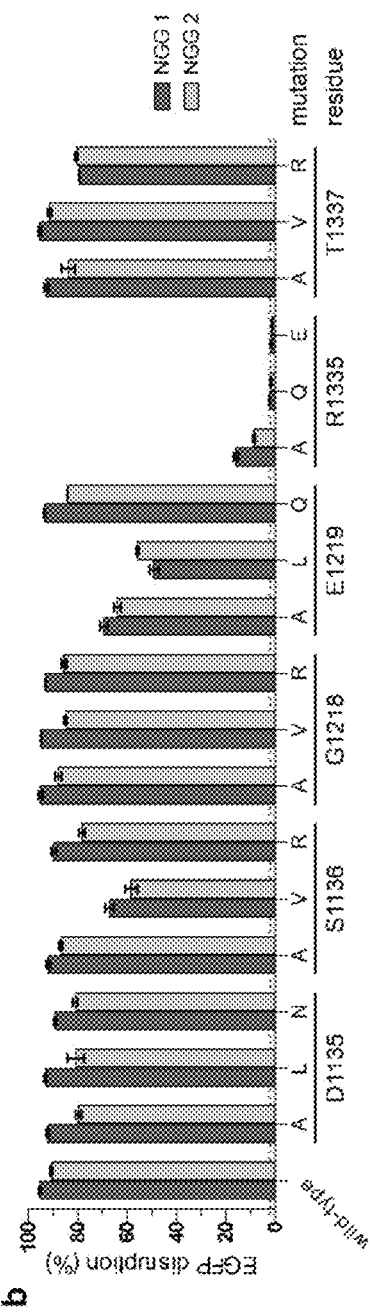
FIGS. 20A-B

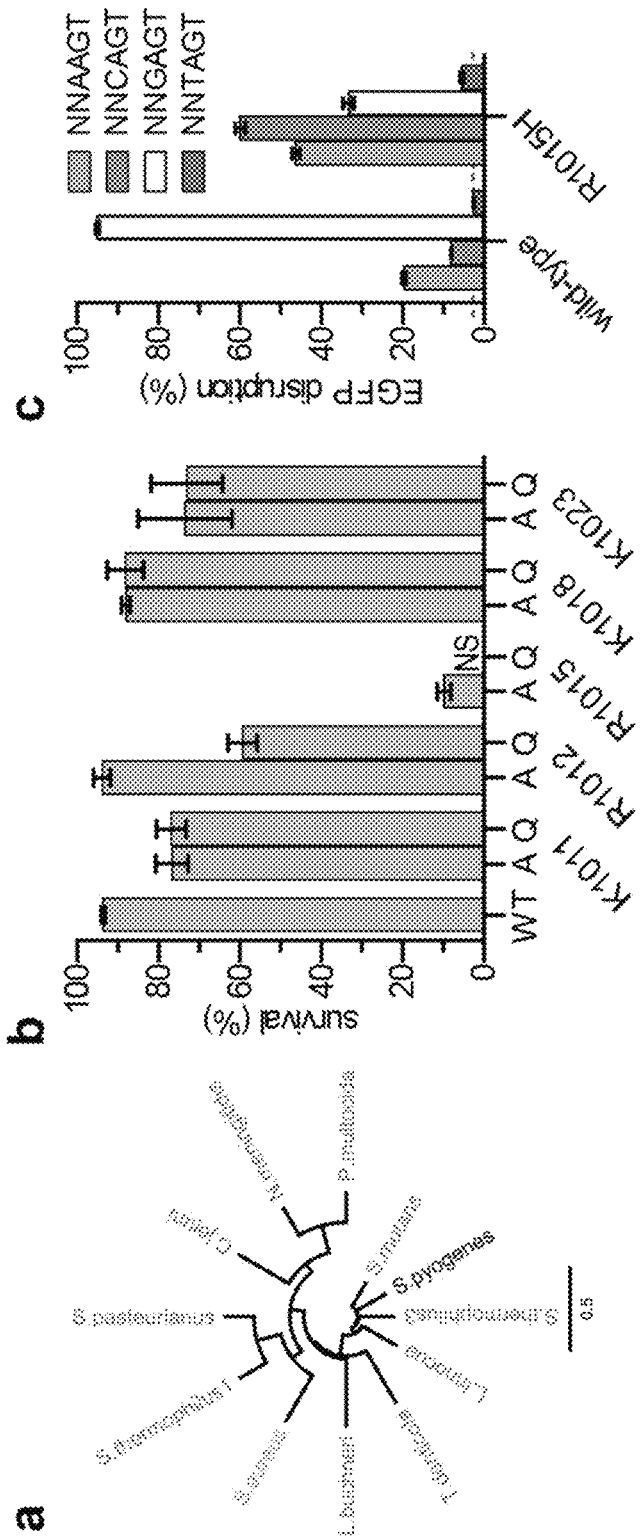
FIGs. 21A-C

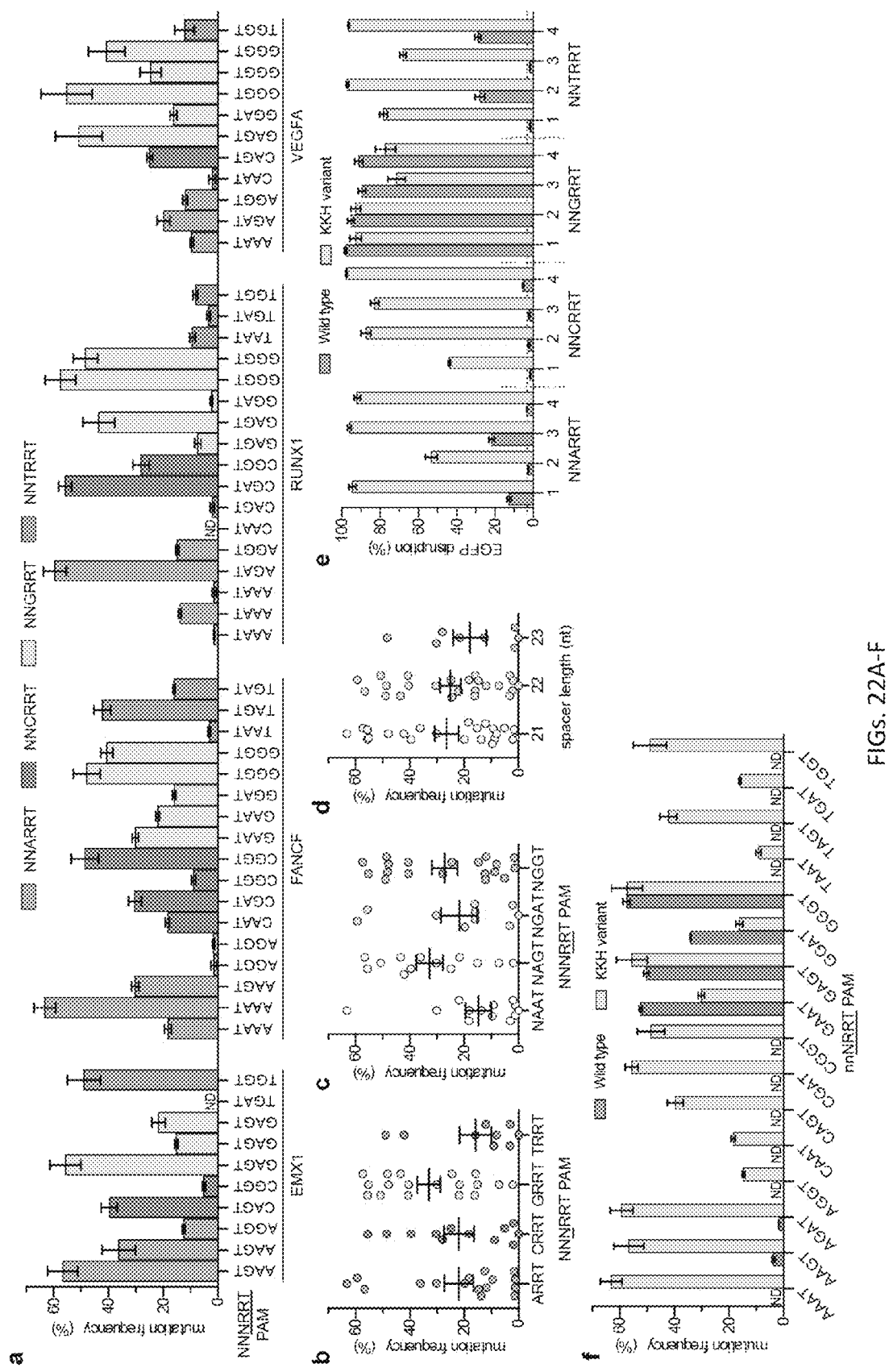
FIGs. 22A-F

FIG. 23B

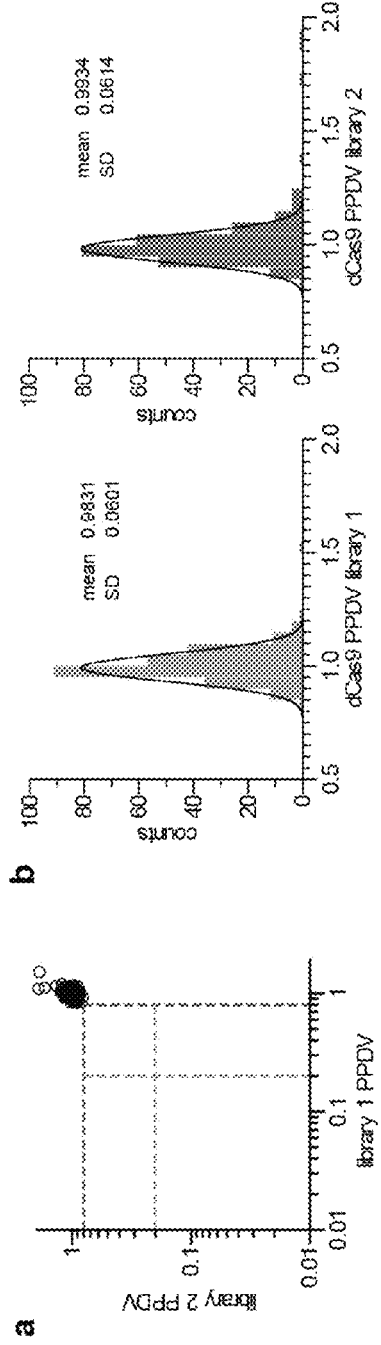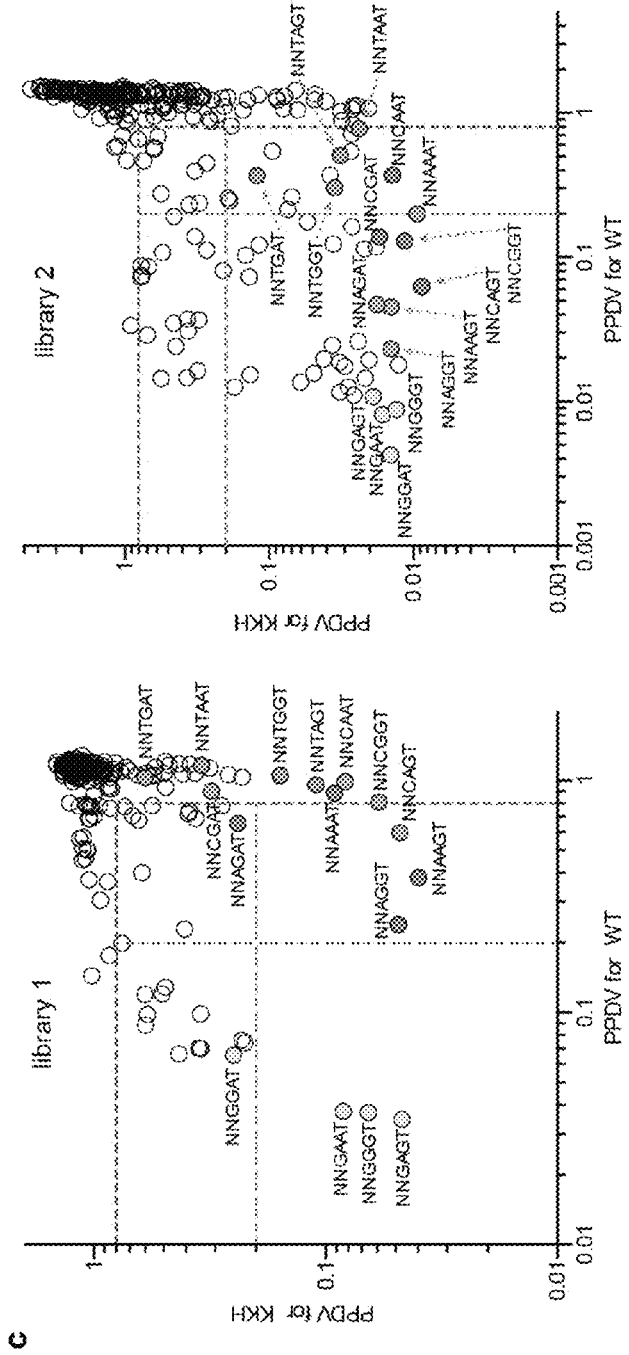
FIG. 34A
FIG. 34B
FIG. 34C

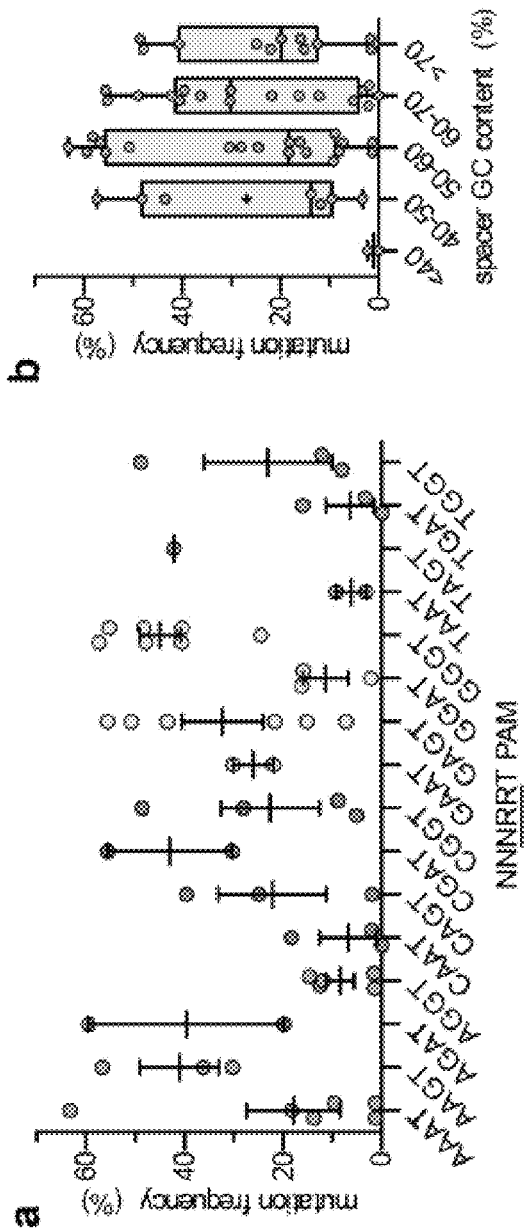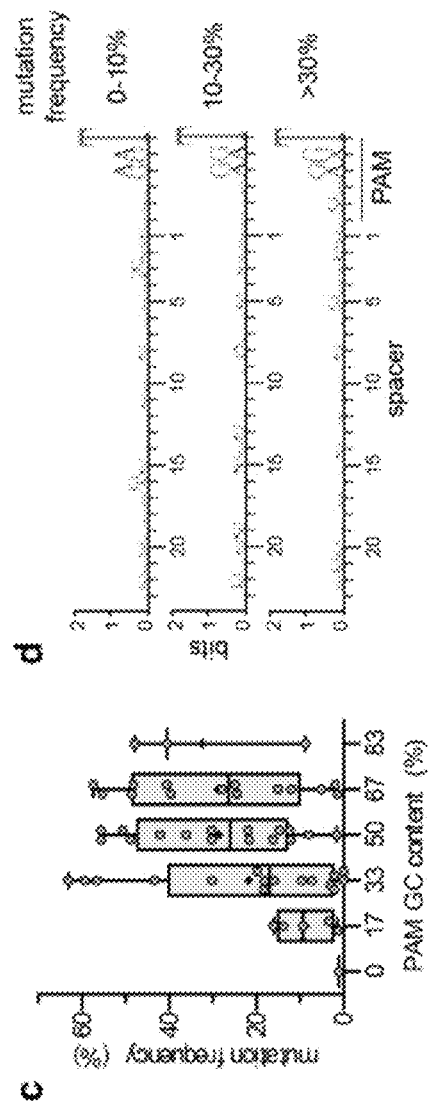
FIG. 35A
FIG. 35B
FIG. 35C
FIG. 35D

US 9,752,132 B2

ENGINEERED CRISPR-CAS9 NUCLEASES WITH ALTERED PAM SPECIFICITY

CLAIM OF PRIORITY

This application is a continuation application of U.S. patent application Ser. No. 15/060,448, filed Mar. 3, 2016, which claims the benefit of U.S. Provisional Patent Application Ser. Nos. 62/127,634, filed on Mar. 3, 2015; 62/165,517, filed on May 22, 2015; 62/239,737, filed on Oct. 9, 2015; and 62/258,402, filed on Nov. 20, 2015. The entire contents of the foregoing are hereby incorporated by reference.

FEDERALLY SPONSORED RESEARCH OR DEVELOPMENT

This invention was made with Government support under Grant Nos. DP1 GM105378, NIH R01 GM107427, and R01 GM088040 awarded by the National Institutes of Health. The Government has certain rights in the invention.

TECHNICAL FIELD

The invention relates, at least in part, to engineered Clustered Regularly Interspaced Short Palindromic Repeats (CRISPRs)/CRISPR-associated protein 9 (Cas9) nucleases with altered and improved Protospacer Adjacent Motif (PAM) specificities and their use in genomic engineering, epigenomic engineering, and genome targeting.

SEQUENCE LISTING

The instant application contains a Sequence Listing which has been submitted electronically in ASCII format and is hereby incorporated by reference in its entirety. Said ASCII copy, created on Jul. 12, 2016, is named 29539-0163003_SL.txt and is 925,050 bytes in size.

BACKGROUND

CRISPR-Cas9 nucleases enable efficient, customizable genome editing in a wide variety of organisms and cell types (Sander & Joung, Nat Biotechnol 32, 347-355 (2014); Hsu et al., Cell 157, 1262-1278 (2014); Doudna & Charpentier, Science 346, 1258096 (2014); Barrangou & May, Expert Opin Biol Ther 15, 311-314 (2015)). Target site recognition by Cas9 is directed by two short RNAs known as the crRNA and tracrRNA (Deltcheva et al., Nature 471, 602-607 (2011); Jinek et al., Science 337, 816-821 (2012)), which can be fused into a chimeric single guide RNA (sgRNA) (Jinek et al., Science 337, 816-821 (2012); Jinek et al., Elife 2, e00471 (2013); Mali et al., Science 339, 823-826 (2013); Cong et al., Science 339, 819-823 (2013)). The 5' end of the sgRNA (derived from the crRNA) can base pair with the target DNA site, thereby permitting straightforward reprogramming of site-specific cleavage by the Cas9/sgRNA complex (Jinek et al., Science 337, 816-821 (2012)). However, Cas9 must also recognize a specific protospacer adjacent motif (PAM) that lies proximal to the DNA that base pairs with the sgRNA (Mojica et al., Microbiology 155, 733-740 (2009); Shah et al., RNA Biol 10, 891-899 (2013); Jinek et al., Science 337, 816-821 (2012); Sapranauskas et al, Nucleic Acids Res 39, 9275-9282 (2011); Horvath et al., J Bacteriol 190, 1401-1412 (2008)), a requirement that is needed to initiate sequence-specific recognition (Sternberg et al., Nature 507, 62-67 (2014)) but that can also constrain the targeting range of these nucleases for genome editing. The broadly used *Streptococcus pyogenes* Cas9 (SpCas9) recognizes a short NGG PAM (Jinek et al., Science 337, 816-821 (2012); Jiang et al., Nat Biotechnol 31, 233-239 (2013)), which occurs once in every 8 bps of random DNA sequence. By contrast, other Cas9 orthologues characterized to date can recognize longer PAMs (Horvath et al., J Bacteriol 190, 1401-1412 (2008); Fonfara et al., Nucleic Acids Res 42, 2577-2590 (2014); Esvelt et al., Nat Methods 10, 1116-1121 (2013); Ran et al., Nature 520, 186-191 (2015); Zhang et al., Mol Cell 50, 488-503 (2013)). For example, *Staphylococcus aureus* Cas9 (SaCas9), one of several smaller Cas9 orthologues that are better suited for viral delivery (Horvath et al., J Bacteriol 190, 1401-1412 (2008); Ran et al., Nature 520, 186-191 (2015); Zhang et al., Mol Cell 50, 488-503 (2013)), recognizes a longer NNGRRT (SEQ ID NO:46) PAM that is expected to occur once in every 32 bps of random DNA. Broadening the targeting range of Cas9 orthologues is important for various applications including the modification of small genetic elements (e.g., transcription factor binding sites (Canver et al. Nature.; 527(7577):192-7 (2015); Vierstra et al., Nat Methods. 12(10):927-30 (2015)) or performing allele-specific alterations by positioning sequence differences within the PAM (Courtney, D. G. et al. Gene Ther. 23(1):108-12 (2015).

SUMMARY

As described herein, the commonly used *Streptococcus pyogenes* Cas9 (SpCas9) as well as the *Staphylococcus aureus* Cas9 (SaCas9) were engineered to recognize novel PAM sequences using structural information, bacterial selection-based directed evolution, and combinatorial design. These altered PAM specificity variants enable robust editing of endogenous gene sites in zebrafish and human cells that cannot be efficiently targeted by wild-type SpCas9 or SaCas9. In addition, we identified and characterized another SpCas9 variant that exhibits improved PAM specificity in human cells, possessing reduced activity on sites with non-canonical NAG and NGA PAMs. Furthermore, we found that two smaller-size Cas9 orthologues with completely different PAM specificities, *Streptococcus thermophilus* Cas9 (St1Cas9) and *Staphylococcus aureus* Cas9 (SaCas9), function efficiently in our bacterial selection system and in human cells, suggesting that our engineering strategies could be extended to Cas9s from other species. Our findings provide broadly useful SpCas9 and SaCas9 variants, referred to collectively herein as "variants" or "the variants".

In a first aspect, the invention provides isolated *Streptococcus pyogenes* Cas9 (SpCas9) proteins with mutations at one or more of the following positions: G1104, S1109, L1111, D1135, S1136, G1218, N1317, R1335, T1337, e.g., comprising a sequence that is at least 80% identical to the amino acid sequence of SEQ ID NO:1. In some embodiments, the variant SpCas9 proteins comprise one or more of the following mutations: G1104K; S1109T; L1111H; D1135V; D1135E; D1135N; D1135Y; S1136N; G1218R; N1317K; R1335E; R1335Q; and T1337R. In some embodiments, the variant SpCas9 proteins comprise the following mutations: D1135; D1135V/R1335Q/T1337R (VQR variant); D1135E/R1335Q/T1337R (EQR variant); D1135V/G1218R/R1335Q/T1337R (VRQR variant); D1135N/G1218R/R1335Q/T1337R (NRQR variant); D1135Y/G1218R/R1335Q/T1337R (YRQR variant); G1104K/D1135V/G1218R/R1335Q/T1337R (KVRQR variant);

S1109T/D1135V/G1218R/R1335Q/T1337R (TVRQR variant); L1111H/D1135V/G1218R/R1335Q/T1337R (HVRQR variant); D1135V/51136N/G1218R/R1335Q/T1337R (VNRQR variant); D1135V/G1218R/N1317K/R1335Q/T1337R (VRKQR variant); or D1135V/G1218R/R1335E/T1337R (VRER variant).

In some embodiments, the variant SpCas9 proteins comprise one or more mutations that decrease nuclease activity selected from the group consisting of mutations at D10, E762, D839, H983, or D986; and at H840 or N863.

In some embodiments, the mutations are: (i) D10A or D10N, and (ii) H840A, H840N, or H840Y.

Also provided herein are isolated *Staphylococcus aureus* Cas9 (SaCas9) proteins with mutations at one or more of the following positions: E782, N968, and/or R1015, e.g., comprising a sequence that is at least 80% identical to the amino acid sequence of SEQ ID NO:2. Also provided herein are isolated *Staphylococcus aureus* Cas9 (SaCas9) proteins with mutations at one, two or more of the following positions: E735, E782, K929, N968, A1021, K1044 and/or R1015. In some embodiments, the variant SaCas9 proteins comprise one or more of the following mutations: R1015Q, R1015H, E782K, N968K, E735K, K929R, A1021T, K1044N. In some embodiments, the variant SaCas9 proteins comprise one or more mutations that decrease nuclease activity selected from the group consisting of mutations at D10, D556, H557, and/or N580. In some embodiments, the variant SaCas9 proteins comprise mutations at D10A, D556A, H557A, N580A, e.g., D10A/H557A and/or D10A/D556A/H557A/N580A.

SpCas9 variants described herein can include the amino acid sequence of SEQ ID NO:1, with mutations at one or more of the following positions: D1135, G1218, R1335, T1337. In some embodiments, the SpCas9 variants can include one or more of the following mutations: D1135V; D1135E; G1218R; R1335E; R1335Q; and T1337R. In some embodiments, the SpCas9 variants can include one of the following sets of mutations: D1135V/R1335Q/T1337R (VQR variant); D1135V/G1218R/R1335Q/T1337R (VRQR variant); D1135E/R1335Q/T1337R (EQR variant); or D1135V/G1218R/R1335E/T1337R (VRER variant).

SaCas9 variants described herein can include the amino acid sequence of SEQ ID NO:2, with mutations at one or more of the following positions: E735, E782, K929, N968, R1015, A1021, and/or K1044. In some embodiments, the SaCas9 variants can include one or more of the following mutations: R1015Q, R1015H, E782K, N968K, E735K, K929R, A1021T, K1044N. In some embodiments, the SaCas9 variants can include one of the following sets of mutations: E782K/N968K/R1015H (KKH variant); E782K/K929R/R1015H (KRH variant); or E782K/K929R/N968K/R1015H (KRKH variant).

Also provided herein are fusion protein comprising the isolated variant SaCas9 or SpCas9 proteins described herein fused to a heterologous functional domain, with an optional intervening linker, wherein the linker does not interfere with activity of the fusion protein. In some embodiments, the heterologous functional domain is a transcriptional activation domain. In some embodiments, the transcriptional activation domain is from VP64 or NF-κB p65. In some embodiments, the heterologous functional domain is a transcriptional silencer or transcriptional repression domain. In some embodiments, the transcriptional repression domain is a Krueppel-associated box (KRAB) domain, ERF repressor domain (ERD), or mSin3A interaction domain (SID). In some embodiments, the transcriptional silencer is Heterochromatin Protein 1 (HP1), e.g., HP1α or HP1β. In some embodiments, the heterologous functional domain is an enzyme that modifies the methylation state of DNA. In some embodiments, the enzyme that modifies the methylation state of DNA is a DNA methyltransferase (DNMT) or a TET protein. In some embodiments, the TET protein is TET1. In some embodiments, the heterologous functional domain is an enzyme that modifies a histone subunit. In some embodiments, the enzyme that modifies a histone subunit is a histone acetyltransferase (HAT), histone deacetylase (HDAC), histone methyltransferase (HMT), or histone demethylase. In some embodiments, the heterologous functional domain is a biological tether. In some embodiments, the biological tether is MS2, Csy4 or lambda N protein. In some embodiments, the heterologous functional domain is FokI.

Also provided herein are isolated nucleic acids encoding the variant SaCas9 or SpCas9 proteins described herein, as well as vectors comprising the isolated nucleic acids, optionally operably linked to one or more regulatory domains for expressing the variant SaCas9 or SpCas9 proteins described herein. Also provided herein are host cells, e.g., mammalian host cells, comprising the nucleic acids described herein, and optionally expressing the variant SaCas9 or SpCas9 proteins described herein.

Also provided herein are methods of altering the genome of a cell, by expressing in the cell an isolated variant SaCas9 or SpCas9 protein described herein, and a guide RNA having a region complementary to a selected portion of the genome of the cell.

Also provided herein are methods for altering, e.g., selectively altering, the genome of a cell by expressing in the cell the variant proteins, and a guide RNA having a region complementary to a selected portion of the genome of the cell.

Also provided are methods for altering, e.g., selectively altering, the genome of a cell by contacting the cell with a protein variant described herein, and a guide RNA having a region complementary to a selected portion of the genome of the cell.

In some embodiments, the isolated protein or fusion protein comprises one or more of a nuclear localization sequence, cell penetrating peptide sequence, and/or affinity tag.

In some embodiments of the methods described herein, the cell is a stem cell, e.g., an embryonic stem cell, mesenchymal stem cell, or induced pluripotent stem cell; is in a living animal; or is in an embryo, e.g., a mammalian, insect, or fish (e.g., zebrafish) embryo or embryonic cell.

Further, provided herein are methods, e.g., in vitro methods, for altering a double stranded DNA (dsDNA) molecule. The methods include contacting the dsDNA molecule with one or more of the variant proteins described herein, and a guide RNA having a region complementary to a selected portion of the dsDNA molecule.

Unless otherwise defined, all technical and scientific terms used herein have the same meaning as commonly understood by one of ordinary skill in the art to which this invention belongs. Methods and materials are described herein for use in the present invention; other, suitable methods and materials known in the art can also be used. The materials, methods, and examples are illustrative only and not intended to be limiting. All publications, patent applications, patents, sequences, database entries, and other references mentioned herein are incorporated by reference in their entirety. In case of conflict, the present specification, including definitions, will control.

Other features and advantages of the invention will be apparent from the following detailed description and FIGs, and from the claims.

DESCRIPTION OF DRAWINGS

The patent or application file contains at least one drawing executed in color. Copies of this patent or patent application publication with color drawing(s) will be provided by the Office upon request and payment of the necessary fee.

FIGS. 1A-J|Evolution and characterization of SpCas9 variants with altered PAM specificities. A, Rational mutation of the SpCas9 residues that make base-specific contacts to the PAM bases is insufficient to alter PAM specificity in the U2OS human cell-based Enhanced Green Fluorescent Protein (EGFP) disruption assay. Disruption frequencies were quantified by flow cytometry; the mean level of disruption observed with the background control is represented by the dashed red line for this and subsequent panels (C, G, H, and J); error bars represent s.e.m., n=3. B, Schematic of the two-plasmid positive selection assay used to alter the PAM specificity of SpCas9. Cleavage of a target site within the positive selection plasmid by a functional Cas9/sgRNA complex is necessary for survival when bacteria are plated on selective media (see also FIGS. 12A-B). C, Combinatorial assembly and testing of mutations obtained from the positive selection for SpCas9 variants that can cleave a target site containing an NGA PAM. SpCas9 Variants were paired with sgRNAs that target sites containing either an NGG or an NGA PAM and activity was assessed using the EGFP disruption assay. Error bars represent s.e.m., n=3. D, Schematic of the negative selection assay, in which cleavage of the selection plasmid results in cell death when bacteria are plated on selective media. This system was adapted to profile the PAM specificity of Cas9 by generating a library of plasmids that contain a randomized sequence adjacent to the 3' end of the protospacer (see also FIG. 13B). E, Scatterplot of the post-selection PAM depletion values (PPDVs) of wild-type SpCas9 with two randomized PAM libraries (each with a different protospacer). PAMs were grouped and plotted by their $2^{nd}/3^{rd}/4^{th}$ positions. The red dashed line indicates the cutoff for statistically significant depletion (obtained from a dCas9 control experiment, see FIG. 13C), and the gray dashed line represents five-fold depletion (PPDV of 0.2). F, PPDV scatterplots for the VQR and EQR SpCas9 variants that recognize PAMs distinct from those recognized by wild-type SpCas9. G, EGFP disruption frequencies for wild-type, VQR, and EQR SpCas9 on sites with NGAN and NGNG PAMs. Error bars represent s.e.m., n=3. H, Combinatorial assembly and testing of mutations obtained from the positive selection for SpCas9 variants that can cleave a target site containing an NGCG PAM. sgRNAs that target sites containing either an NGGG or an NGCG PAM were assessed for Cas9 targeting using the EGFP disruption assay. Error bars represent s.e.m., n=3. I, PPDV scatterplot for the VRER variant. J, EGFP disruption frequencies for wild-type and VRER SpCas9 on sites with NGCN and NGNG PAMs. Error bars represent s.e.m., n=3.

FIGS. 2A-F|SpCas9 variants with evolved PAM specificities robustly modify endogenous sites in zebrafish embryos and human cells. A, Quantification of mutagenesis frequencies in zebrafish embryos induced by wild-type or VQR SpCas9 on endogenous gene sites bearing NGAG PAMs. Mutation frequencies were determined using the T7E1 assay; error bars represent s.e.m., n=5 to 9 individual embryos. B, Mutation frequencies of the VQR variant quantified by T7E1 assay at 16 target sites in four endogenous human genes with sgRNAs targeted to sites containing NGAG, NGAT, and NGAA PAMs. Error bars represent s.e.m., n=3. C, Mutation frequencies of wild-type SpCas9 on endogenous human gene target sites with NGA PAMs. For ease of comparison, the mutation frequencies for the VQR variant using the same sgRNAs are re-presented here (same data shown in panel B). Error bars represent s.e.m., n=3; n.d., not detectable by T7E1. D, Mutation frequencies of wild-type, VRER, and VQR SpCas9 at nine target sites containing NGCG PAMs in three endogenous human genes quantified by T7E1 assay. sgRNA complementarity lengths of 19 and 20 nt were used; error bars represent s.e.m., n=3. E, Representation of the number sites in the human genome with 20 nt spacers targetable by wild-type, VQR, and VRER SpCas9. F, Number of off-target cleavage sites identified by GUIDE-seq for the VQR and VRER SpCas9 variants using sgRNAs from panels B and D.

FIGS. 3A-G|A D1135E mutation improves the PAM recognition and spacer specificity of SpCas9. A, PPDV scatterplots for wild-type and D1135E SpCas9 (left and right panels, respectively) for the two randomized PAM libraries. PAMs were grouped and plotted by their $2^{nd}/3^{rd}/4^{th}$ positions. The data shown for wild-type SpCas9 is the same as the plot from FIG. 1D and is re-presented here for ease of comparison. The red dashed line indicates PAMs that are statistically significantly depleted (see FIG. 13C), and the gray dashed line indicates a five-fold depletion cutoff (PPDV of 0.2). B, EGFP disruption activities of wild-type and D1135E SpCas9 on sites that contain NGG, NAG, and NGA PAMs in human cells. Disruption frequencies were quantified by flow cytometry; the mean level of disruption observed with the background control is represented by the dashed red line for this panel and (D); error bars represent s.e.m., n=3; mean fold change in activity is shown. C, Mutagenesis frequencies detected by T7E1 for wild-type and D1135E SpCas9 at six endogenous sites in human cells. Error bars represent s.e.m., n=3; mean fold change in activity is shown. D, Titration of the amount of wild-type or D1135E SpCas9-encoding plasmid transfected for EGFP disruption experiments in human cells. The amount of sgRNA plasmid used for all of these experiments was fixed at 250 ng. Two sgRNAs targeting different EGFP sites were used; error bars represent s.e.m., n=3. E, Targeted deep-sequencing of on- and off-target sites for 3 sgRNAs using wild-type and D1135E SpCas9 (SEQ ID NOS 660-687, respectively, in order of appearance). The on-target site is shown at the top, with off-target sites listed below highlighting mismatches to the on-target. Fold decreases in activity with D1135E relative to wild-type SpCas9 at off-target sites greater than the change in activity at the on-target site are highlighted in green; control indel levels for each amplicon are reported. F, Summary of the targeted deep-sequencing data, plotted as the fold-decrease in activity at on- and off-target sites using D1135E relative to the indel frequency observed with wild-type SpCas9. G, Summary of GUIDE-seq detected changes in specificity between wild-type and D1135E at off-target sites, plotted as the normalized fold-change in specificity using D1135E versus the read counts at that off-target site using wild-type SpCas9 (see also FIG. 18C). Estimated fold-gain in specificity at sites without read-counts for D1135E are not plotted (see FIG. 18C).

FIGS. 4A-G|Characterization of St1Cas9 and SaCas9 orthologues in bacteria and human cells. A, PPDV scatterplots for St1Cas9 using the two randomized PAM libraries. PAMs were grouped and plotted by their $3^{rd}/4^{th}/5^{th}/6^{th}$ positions. sgRNA complementarity lengths of 20 and 21 nucleotides were used to program St1Cas9 for both libraries (left and right panels, respectively). The red dashed line indicates PAMs that are statistically significantly depleted (see FIG. 13C), and the gray dashed line represents five-fold depletion (PPDV of 0.2); α, PAM previously predicted by a bioinformatic approach[27]; β, PAMs previously identified under stringent experimental conditions[20]; *, novel PAMs discovered in this study; γ, PAMs previously identified under moderate experimental conditions[20] (PAM 1 disclosed as SEQ ID NO: 3). B, PPDV scatterplots for SaCas9 using the two randomized PAM libraries. PAMs were grouped and plotted by their $3^{rd}/4^{th}/5^{th}/6^{th}$ positions. sgRNA complementarity lengths of 21 and 23 nucleotides were used to program SaCas9 for both libraries (left and right panels, respectively). PAMs identified for SaCas9 are shown, with PAMs 1-3 consistently depleted across all combinations of spacer and spacer length used in these experiments (PAMs 1-3 disclosed as SEQ ID NOS 4, 6 and 5, respectively, in order of appearance). C, Survival percentages of St1Cas9 and SaCas9 in the bacterial positive selection when challenged with selection plasmids that harbor different target sites and PAMs indicated on the x-axis. Highly depleted PAMs from panels (A) and (B) for St1Cas9 and SaCas9 were used for the target sites in the positive selection plasmids (SEQ ID NOS 3, 3, 5, 5, 5 and 3, respectively, in order of appearance). D, E, EGFP disruption activities of St1Cas9 (panel D) or SaCas9 (panel E) on sites in EGFP that contain NNAGAA (SEQ ID NO:3) or NNGGGT (SEQ ID NO:4)/NNGAGT (SEQ ID NO:5) PAMs, respectively. Matched sgRNAs of different lengths for the same site are indicated; disruption frequencies were quantified by flow cytometry; the mean frequency of EGFP disruption obtained with a negative control is represented by the dashed red line; error bars represent s.e.m., n=3. F, G, Mutation frequencies of St1Cas9 (panel F) and SaCas9 (panel G) quantified by T7E1 assay at sites in four endogenous human genes that contain NNAGAA (SEQ ID NO:3) or NNGGGT (SEQ ID NO:4)/NNGAGT (SEQ ID NO:5)/NNGAAT (SEQ ID NO:6) PAMs, respectively. Error bars represent s.e.m., n=3; n.d., not detectable by T7E1.

Figure 5A:
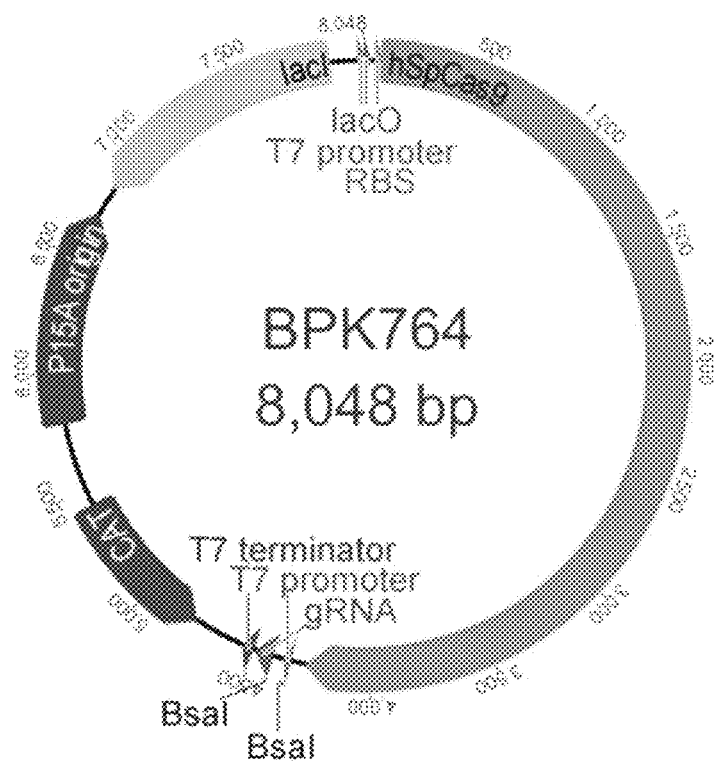
FIGS. 5A-J. Sequences and Maps—plasmids used in this study
Figure 5B:
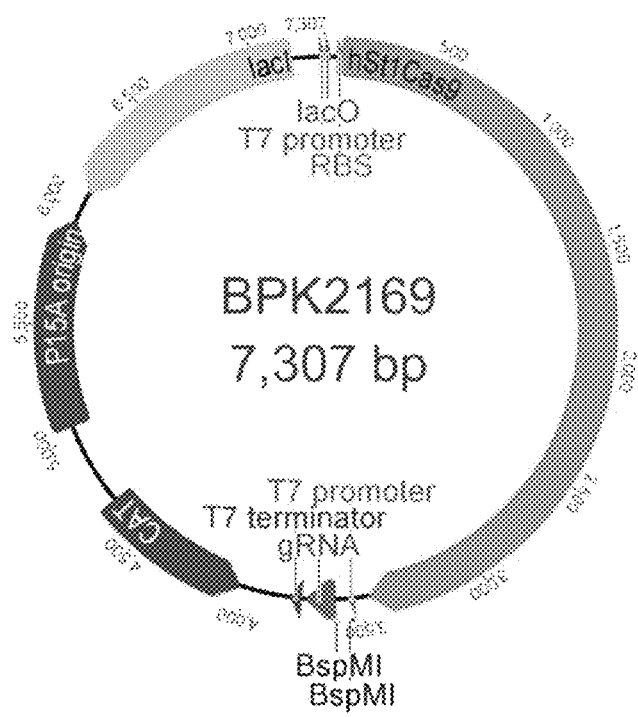
Figure 5C:
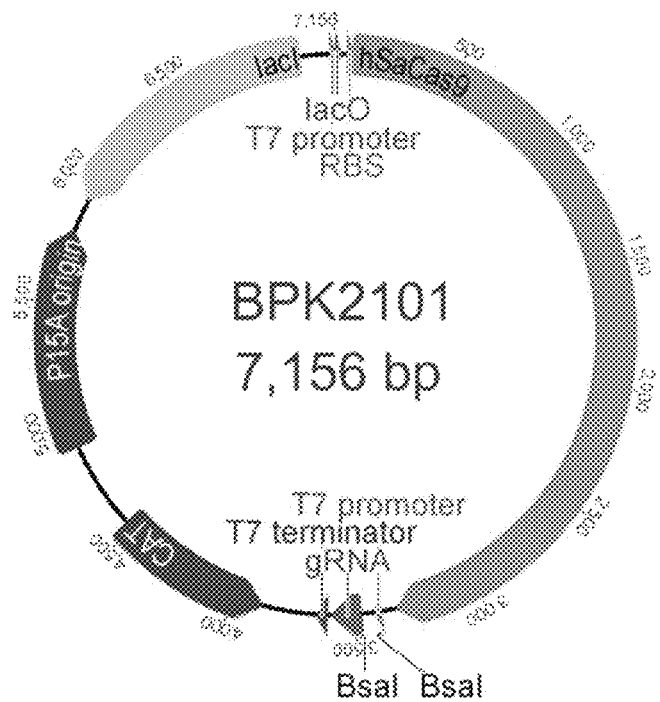
Figure 5D:
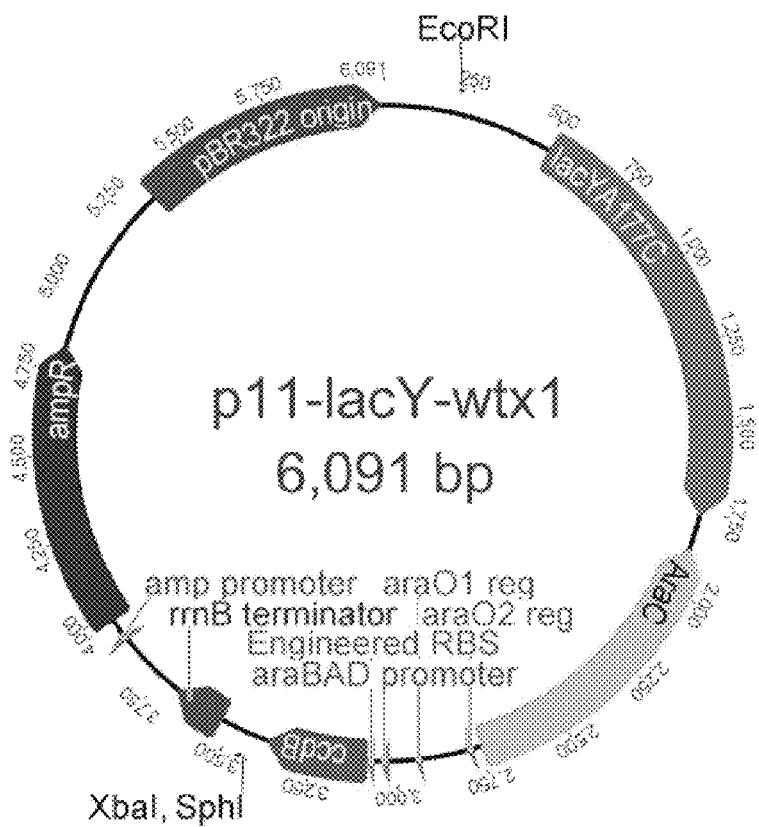
Figure 5E:
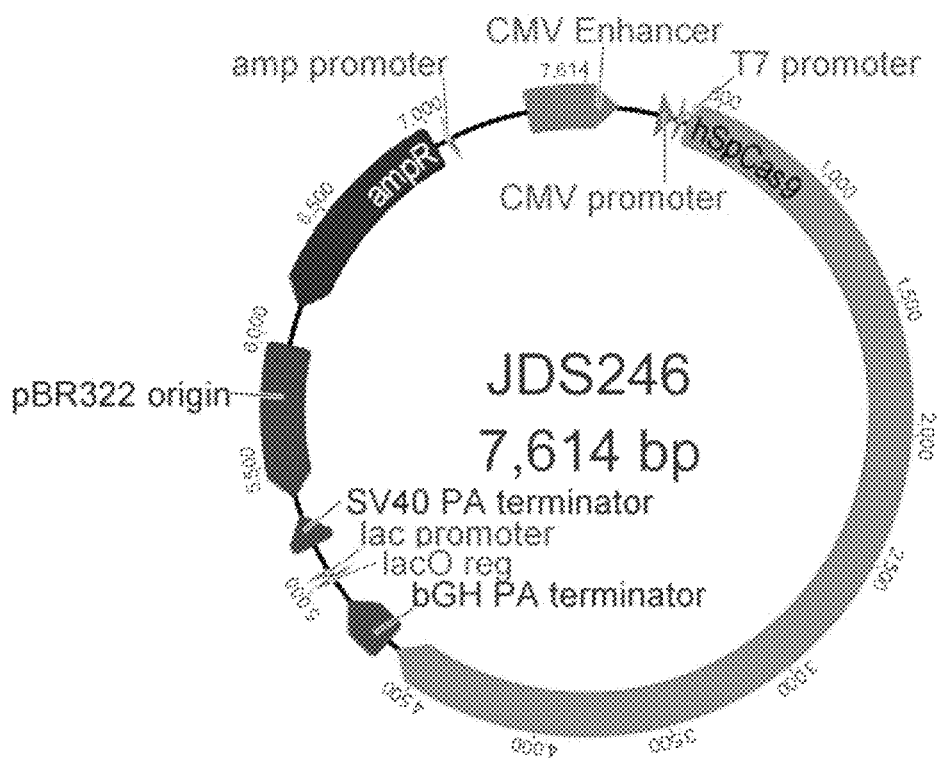
Figure 5F:
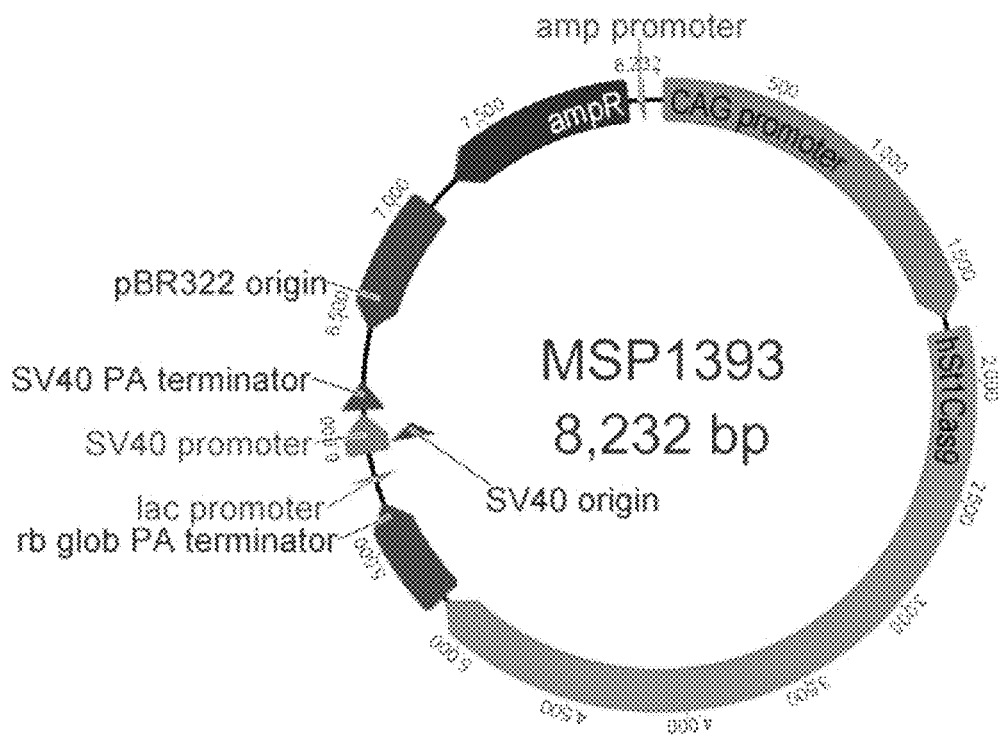
Figure 5G:
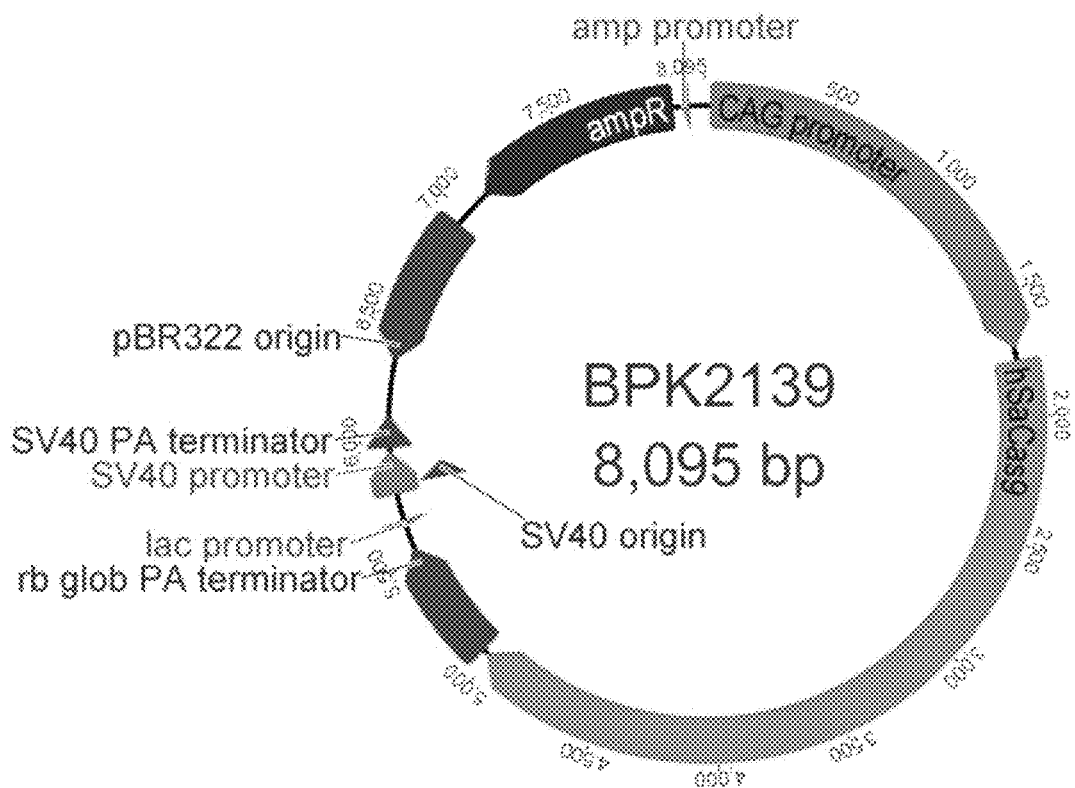
Figure 5H:
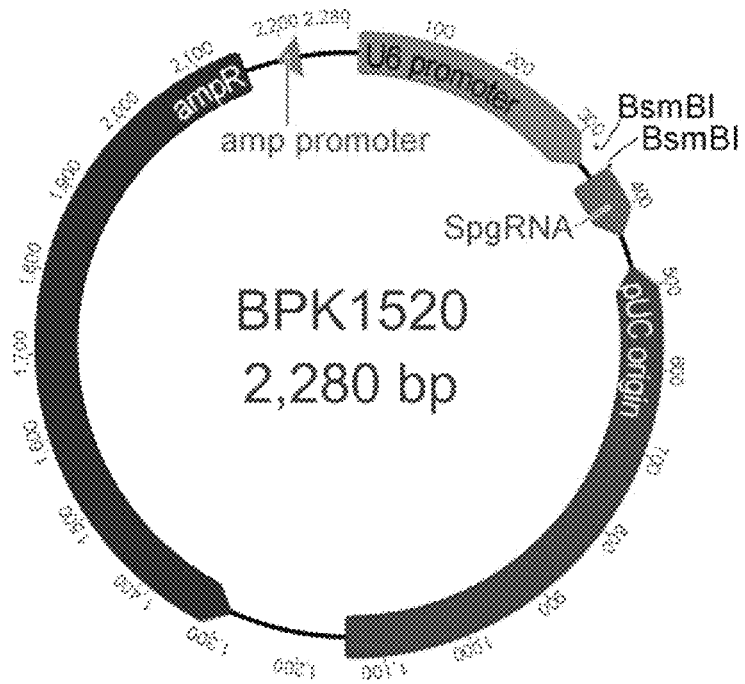
Figure 5I:
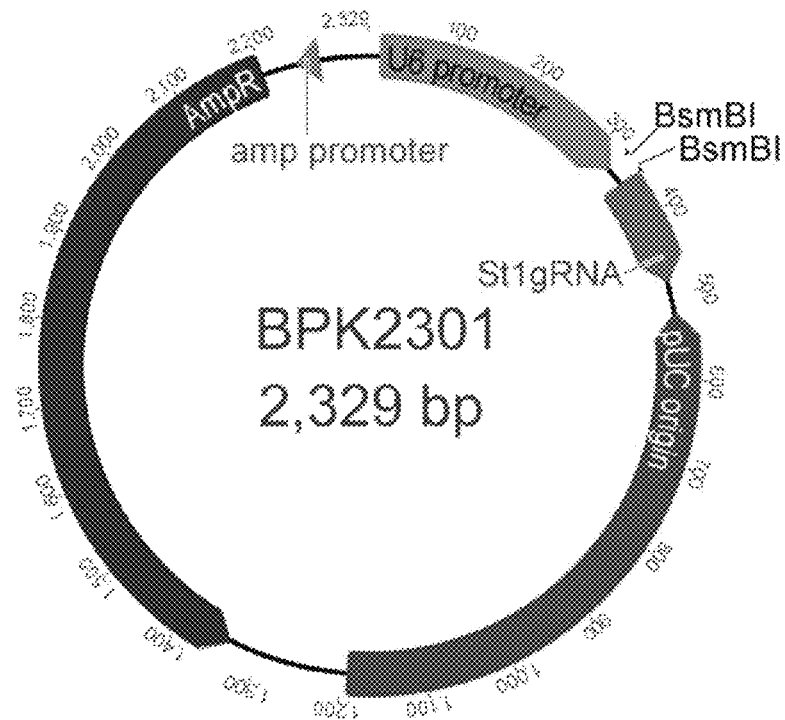
Figure 5J:
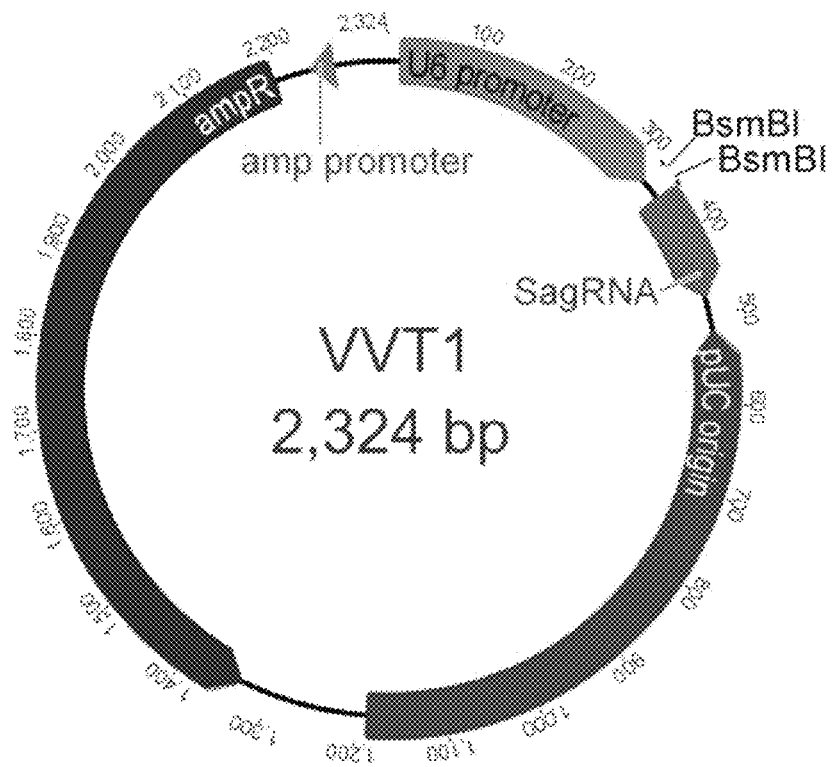

| FIG | Name | SEQ ID NO | Description |
|---|---|---|---|
| 5A | BPK764 | 7 | T7-humanSpCas9-NLS-3xFLAG-T7-BsaIcassette-SpgRNA<br>T7 promoters: nts 1-17 and 4360-4376; human codon optimized S. pyogenes Cas9 88-4224; Nuclear Localization Signal (NLS) (CCCAAGAAGAAGAGGAAAGTC (SEQ ID NO: 650)) at nts 4198-4218, 3xFLAG tag 4225-4290, BsaI sites 4379-4384 and 4427-4432, gRNA (GTTTTAGAGCTAGAAATAGCAAGTTAAAATAAGGCTAGTCCG TTATCAACTTGAAAAAGTGGCACCGAGTCGGTGC (SEQ ID NO: 651)) 4434-4509, T7 terminator 4252-4572 of SEQ ID NO:7 |
|  | MSP712 | 8 | T7-humanSpdCas9(D10A/H840A)-T7-BsaIcassette-SpgRNA<br>T7 promoters at nts 1-17 and 4360-4376, human codon optimized S. pyogenes Cas9 88-4293, modified codons iat 115-117 and 2605-2607, bold and underlined, NLS (CCCAAGAAGAAGAGGAAAGTC (SEQ ID NO: 650)) at nts 4198-4218, 3xFLAG tag 4225-4290, BsaI sites 4379-4384 and 4427-4432, gRNA (GTTTTAGAGCTAGAAATAGCAAGTTAAAATAAGGCTAGT CCGTTATCAACTTGAAAAAGTGGCACCGAGTCGGTGC (SEQ ID NO: 651)) at nts 4434-4509, T7 terminator 4252-4572 of SEQ ID NO: 8 |
| 5B | BPK2169 | 9 | T7-humanSt1Cas9-NLS-T7-BspMIcassette-St1gRNA<br>T7 promoters at 1-17 and 3555-3571, human codon optimized S. thermophilus1 Cas9 at 88-3489, NLS at 3454 to 3486; BspMI sites at 3577-3582 and 3625-3630, gRNA at 3635-3763, T7 terminator 3778-3825 of SEQ ID NO: 9. |
| 5C | BPK2101 | 10 | T7-humanSaCas9-NLS-3xFLAG-T7-BsaIcassette-SagRNA<br>T7 promoters at 1-17 and 3418-3434, human codon optimized S. aureus Cas9 at 88-3352, NLS at 3256-3276, 3xFLAG tag at 3283-3348, BsaI sites at 3437-3442 and 3485-3490, gRNA at 3492-3616, T7 terminator at 3627-2674 of SEQ ID NO: 10. |
| 5D | p11-lacY-wtx1[17] | — | BAD-ccDB-Amp$^R$-AraC-lacY(A177C) |
| 5E | JDS246 | 11 | CMV-T7-humanSpCas9-NLS-3xFLAG ADDGENE ID: 43861<br>Human codon optimized S. pyogenes Cas9 1-4206, NLS at 4111-4131, 3xFLAG tag at 4138-4203 of SEQ ID NO: 11. |
|  | MSP469 | 12 | CMV-T7-humanSpCas9(D1135V/R1335Q/T1337R)-NLS-3xFLAG (VQR variant)<br>Human codon optimized S. pyogenes Cas9 1-4206, modified codons at 3403-3405, 4003-4005, and 4009-4011, NLS at 411-4131, 3xFLAG tag 4138-4203 of SEQ ID NO: 12. |
|  | MSP680 | 13 | CMV-T7-humanSpCas9(D1135E/R1335Q/T1337R)-NLS-3xFLAG (EQR variant)<br>Human codon optimized S. pyogenes Cas9 1-4206, modified |

-continued

| FIG | Name | SEQ ID NO | Description |
|---|---|---|---|
| | | | codons at 3403-3405, 3652-3654, 4003-4005, and 4009-4011, NLS at 411-4131, 3xFLAG tag 4138-4203 of SEQ ID NO: 13. |
| | MSP1101 | 14 | CMV-T7-humanSpCas9(D1135V/G1218R/R1335E/T1337R)-NLS-3xFLAG (VRER variant) Human codon optimized S. pyogenes Cas9 1-4206, modified codons at 3403-3405, 4003-4005, and 4009-4011, NLS at 411-4131, 3xFLAG tag 4138-4203 of SEQ ID NO: 14 |
| | MSP977 | 15 | CMV-T7-humanSpCas9(D1135E)-NLS-3xFLAG Human codon optimized S. pyogenes Cas9 1-4206, modified codons at 3403-3405, NLS at 411-4131, 3xFLAG tag 4138-4203 of SEQ ID NO: 15. |
| 5F | MSP1393 | 16 | CAG-humanSt1Cas9-NLS Human codon optimized S. thermophilus1 Cas9 1-3402, NLS at 3367-3399 of SEQ ID NO: 16. |
| 5G | BPK2139 | 17 | CAG-humanSaCas9-NLS-3xFLAG Human codon optimized S. aureus Cas9 1-3195, NLS 3169-3189, 3xFLAG tag 3196-3261 of SEQ ID NO: 17. |
| 5H | BPK1520 | 18 | U6-BsmBIcassette-SpgRNA U6 promoter at 1-318, BsmBI sites at 320-325 and 333-338, S. pyogenes gRNA 339-422, U6 terminator 416-422 of SEQ ID NO: 18. |
| 5I | BPK2301 | 19 | U6-BsmBIcassette-St1gRNA U6 promoter 1-318, BsmBI sites at 320-325 and 333-338, S. thermophilus1 gRNA 340-471, U6 terminator 464-471 of SEQ ID NO: 19. |
| 5J | VVT1 | 20 | U6-BsmBIcassette-SagRNA U6 promoter 1-318, BsmBI sites at 320-325 and 333-338, S. aureus gRNA 340-466, U6 terminator 459-466 of SEQ ID NO: 20. |

Figure 6:
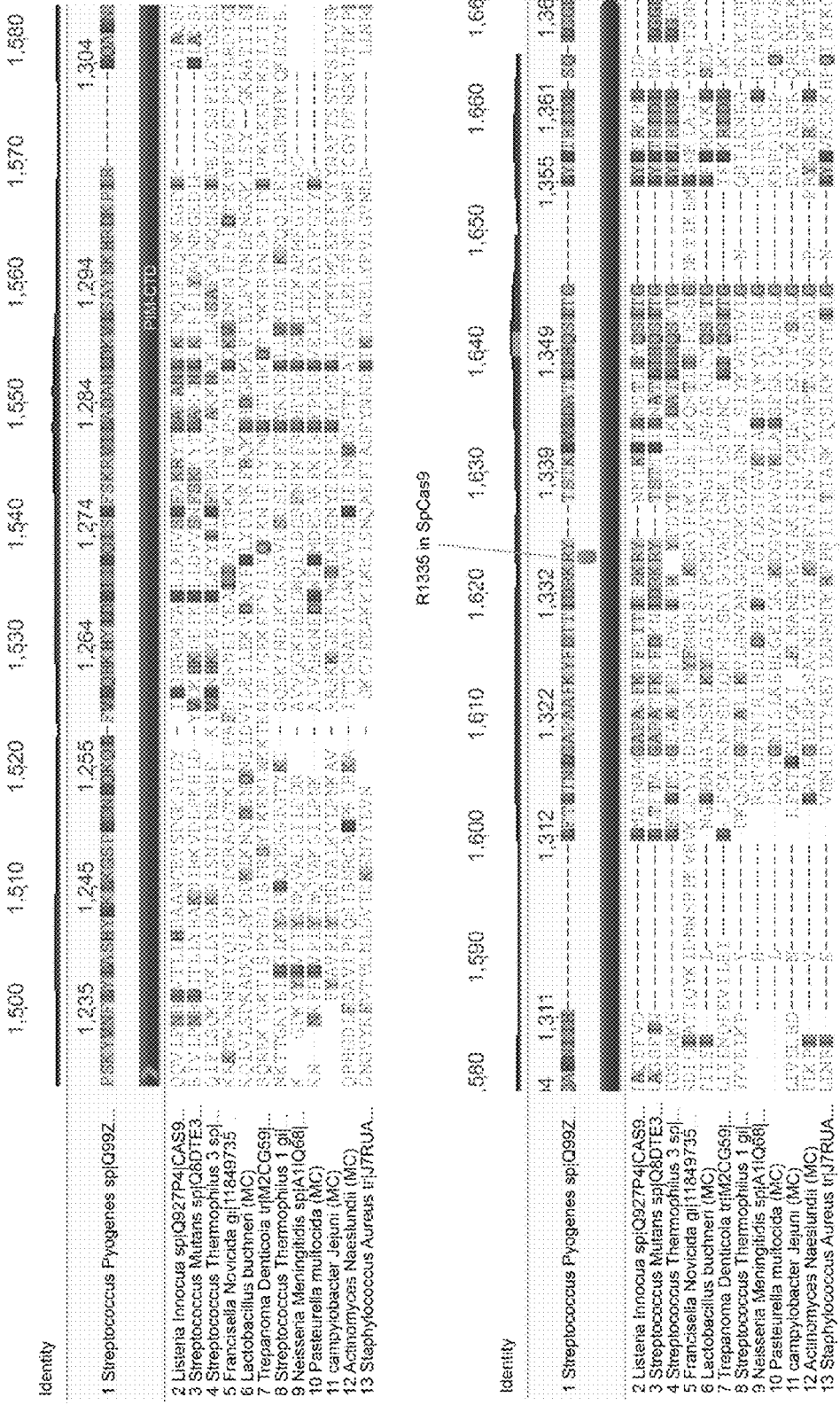

FIG. 6|Alignment of Cas9 orthologues to predict PAM-interacting residues of SaCas9. The PAM-interacting domains of SpCas9, SaCas9, and 11 other Cas9 orthologues were aligned to identify PAM contacting residues in SaCas9, based on what is known for SpCas9. Top, Top, S. Pyogenes, amino acids 1229-1368 of SEQ ID NO:1, then SEQ ID NOs:29-40, respectively.

Figure 7:
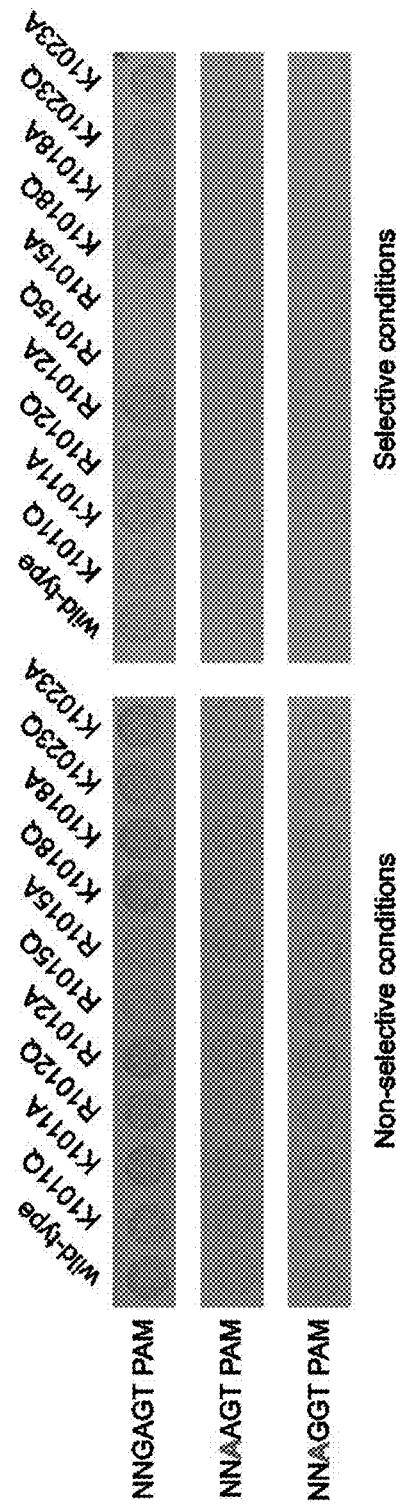

FIG. 7|Substitutions in SaCas9 assessed for activity against different PAMs in the bacterial screen. Based on the alignment from FIG. 6, single amino acid substitutions were tested in the bacterial positive selection to screen for effects on activity against a canonical NNGAGT (SEQ ID NO:5) and non-canonical NNAAGT (SEQ ID NO:41) and NNAGGT (SEQ ID NO:42) PAMs. Bacterial colonies on the selective media suggest that the SaCas9 variant has activity against a site containing the indicated PAM.

Figure 8A:
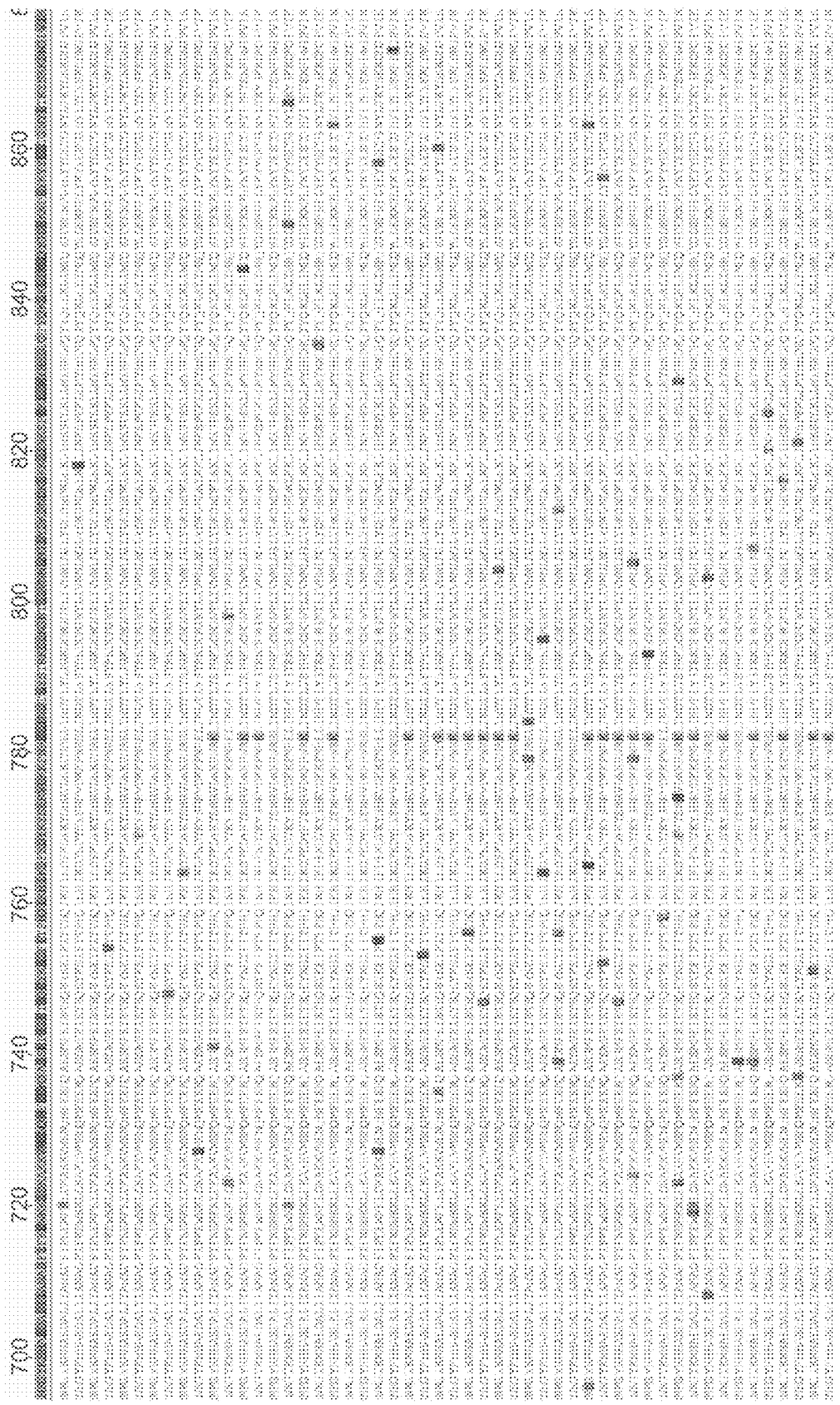
Figure 8B:
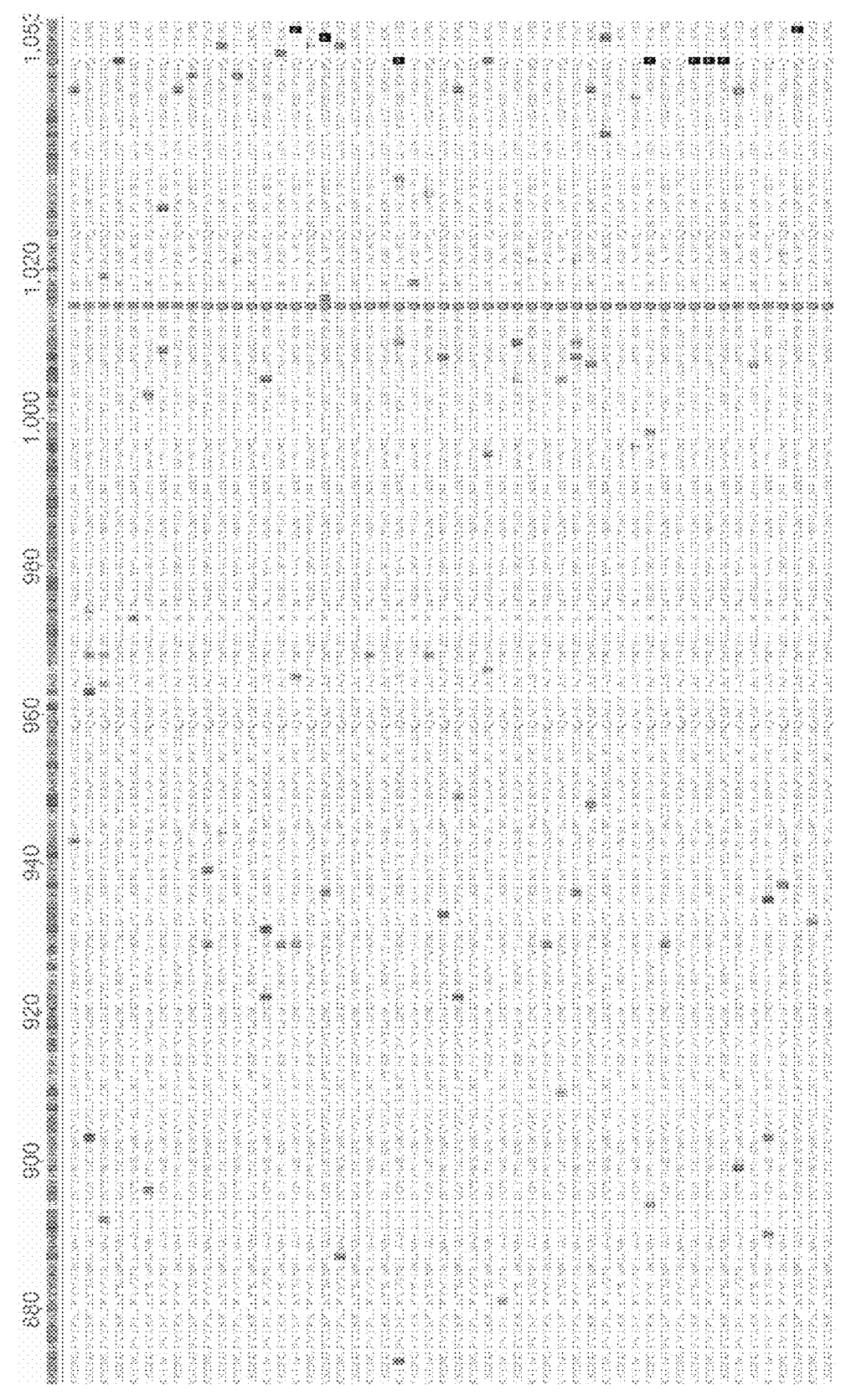

FIGS. 8A-B|Summary of amino acid substitutions that enable SaCas9 variants to target NNARRT (SEQ ID NO:43) PAMs. Amino acid sequences of the PAM-interacting domain of 52 selected mutant SaCas9 clones that enabled survival in bacteria against sites containing an NNARRT (SEQ ID NO:43) PAM; the sequences presented are partial sequences of SEQ ID NOs:53-104 shown in Table 6 (SEQ ID NOS 967-1019, respectively, in order of appearance). Figure discloses "IIKKG" as SEQ ID NO: 966.

Figure 9:
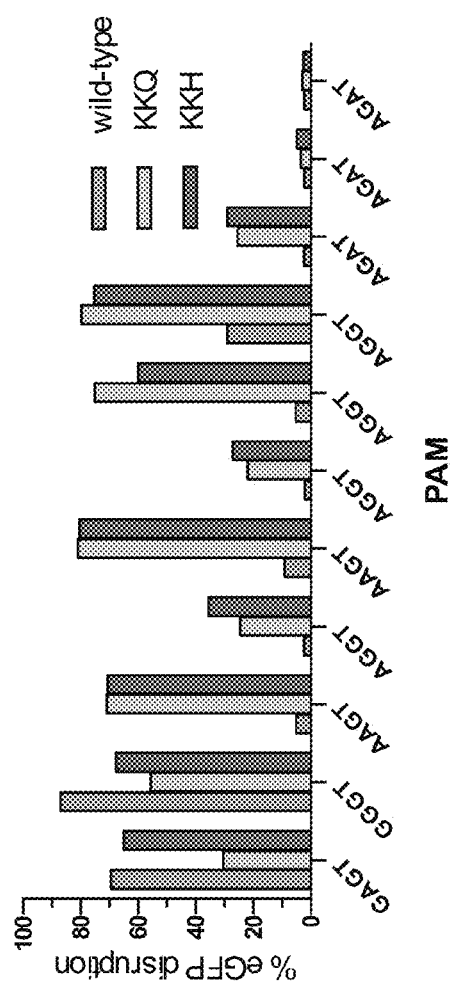

FIG. 9|Human cell activity of wild-type and engineered SaCas9 variants. Activity of wild-type, KKQ, and KKH SaCas9 was assessed in the human cell EGFP reporter assay against sites containing NNRRRT (SEQ ID NO:45) PAMs.

Figure 10:
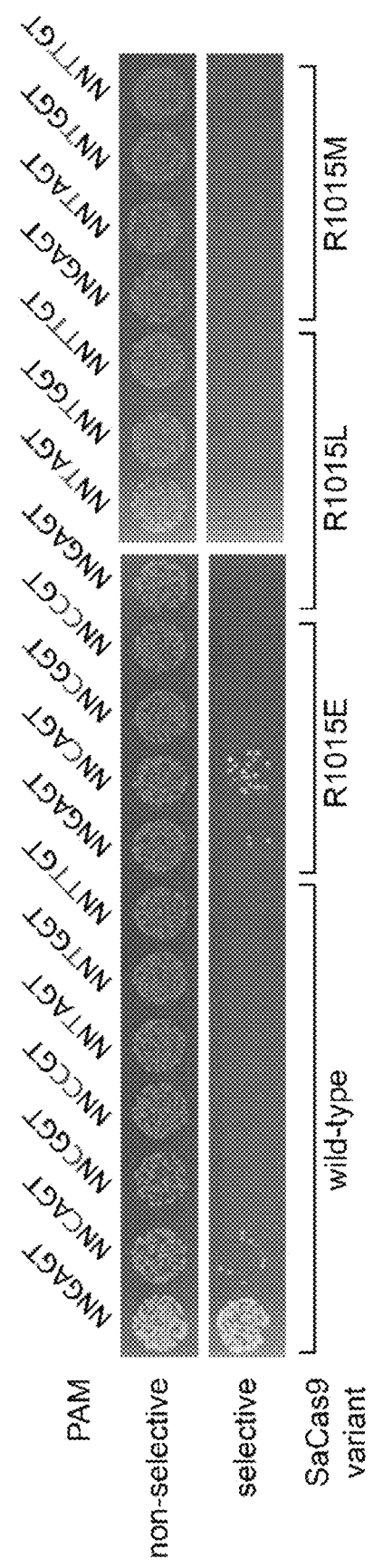

FIG. 10. SaCas9 activity against non-canonical PAMs in bacteria, and how directed mutations at R1015 impact activity against the same non-canonical PAMs (SEQ ID NOS 5, 511-514, 5, 511-512, 5, 513-514, 5 and 513-514, respectively, in order of appearance).

Figure 11:
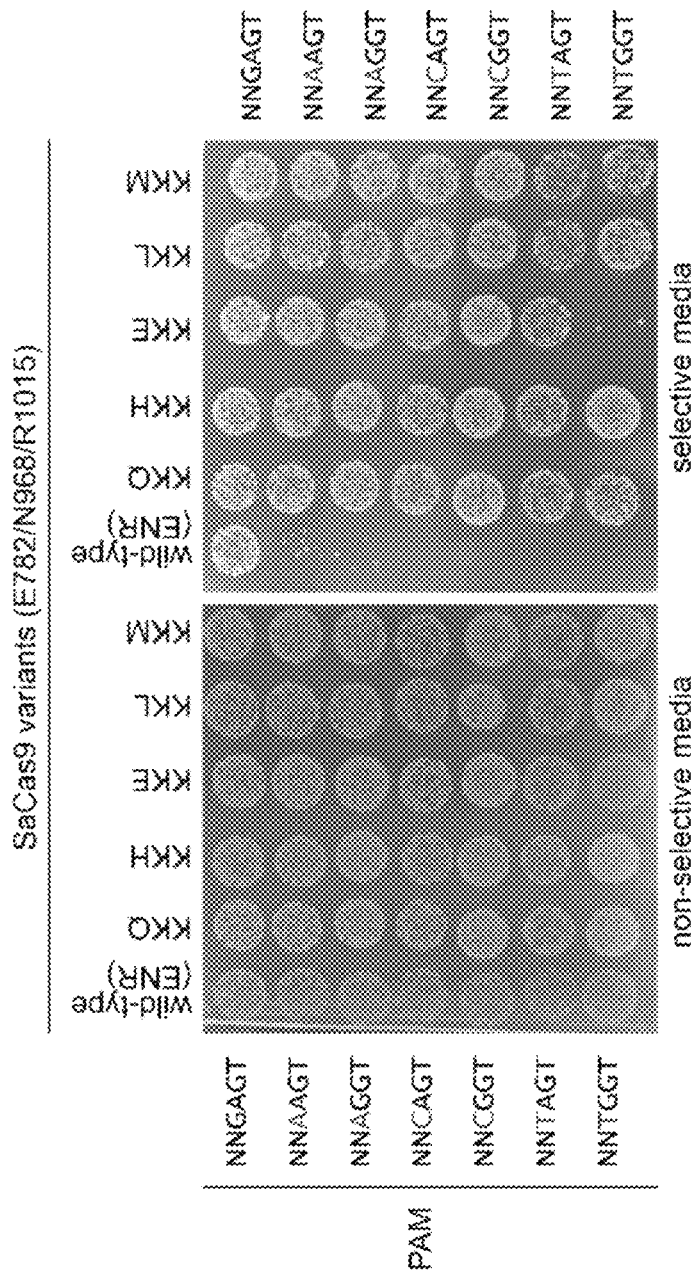

FIG. 11. Engineered variants can recognize PAMs of the form NNNRRT (SEQ ID NOS 5, 41-42, and 511-514, respectively, in order of appearance, on both the left and right side of the figure)

Figure 12A:
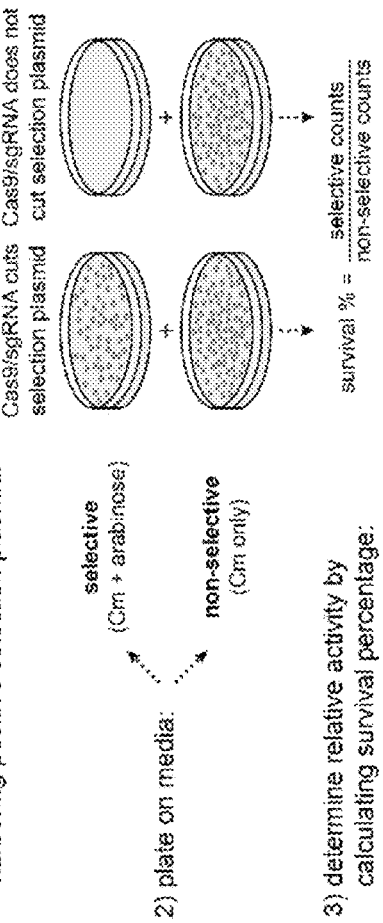

FIGS. 12A-B|Bacterial-based positive selection used to engineer altered PAM specificity variants of SpCas9. A, Expanded schematic of the positive selection from FIG. 1B (left panel), and validation that SpCas9 behaves as expected in the positive selection (right panel). Spacer 1, SEQ ID NO:105; Spacer 2, SEQ ID NO:106. B, Schematic of how the positive selection was adapted to select for SpCas9 variants that have altered PAM recognition specificities. A library of SpCas9 clones with randomized PAM-interacting (PI) domains (residues 1097-1368) is challenged by a selection plasmid that harbors an altered PAM (target site disclosed as SEQ ID NO: 688). SpCas9 variants that survive the selection by cleaving the positive selection plasmid are sequenced to determine the mutations that enable altered PAM specificity.

FIGS. 13A-D|Bacterial cell-based site-depletion assay for profiling the global PAM specificities of Cas9 nucleases. A, Expanded schematic illustrating the negative selection from FIG. 1D (left panel), and validation that wild-type SpCas9 behaves as expected in a screen of sites with functional (NGG) and non-functional (NGA) PAMs (right panel). B, Schematic of how the negative selection was used as a site-depletion assay to screen for functional PAMs by constructing negative selection plasmid libraries containing 6 randomized base pairs in place of the PAM. Selection plasmids that contain PAMs cleaved by a Cas9/sgRNA of interest are depleted while PAMs that are not cleaved (or poorly cleaved) are retained. The frequencies of the PAMs following selection are compared to their pre-selection frequencies in the starting libraries to calculate the post-selection PAM depletion value (PPDV). Spacer 1, SEQ ID NO: 689; Spacer 2, SEQ ID NO: 690. C, D, A cutoff for statistically significant PPDVs was established by plotting the PPDV of PAMs for catalytically inactive SpCas9 (dCas9) (grouped and plotted by their 2nd/3rd/4th positions) for the two randomized PAM libraries (C). A threshold of 3.36 standard deviations from the mean PPDV for the two libraries was calculated (red lines in (D)), establishing that any PPDV deviation below 0.85 is statistically significant compared to dCas9 treatment (red dashed line in (C)). The gray dashed line in (C) indicates a five-fold depletion in the assay (PPDV of 0.2).

Figure 14:
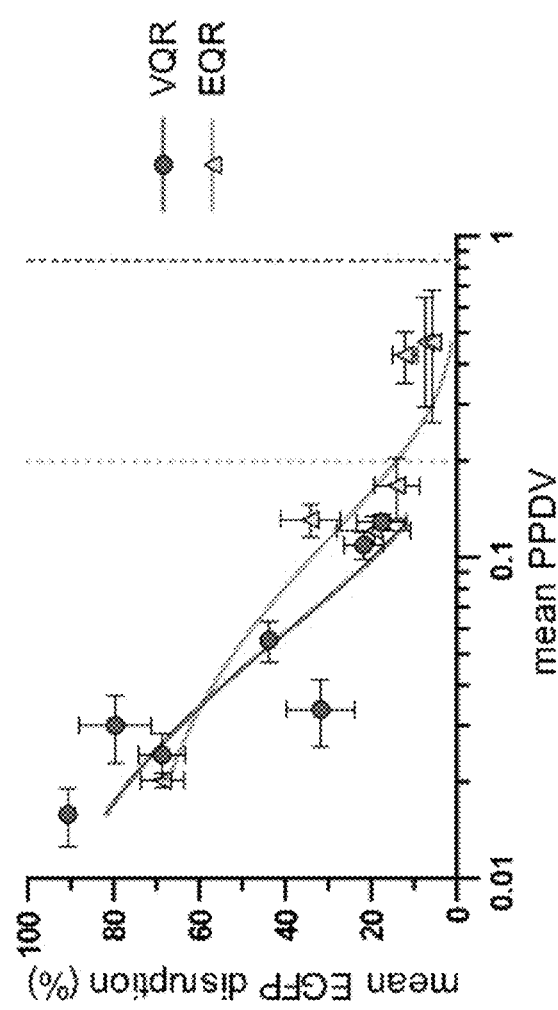

FIG. 14|Concordance between the site-depletion assay and EGFP disruption activity. Data points represent the average EGFP disruption of the two NGAN and NGNG PAM sites for the VQR and EQR SpCas9 variants (FIG. 1G) plotted against the mean PPDV observed for library 1 and 2 (FIG. 1F) for the corresponding PAM. The red dashed line indicates PAMs that are statistically significantly depleted (PPDV of 0.85, see FIG. 13C), and the gray dashed line represents five-fold depletion (PPDV of 0.2). Mean values are plotted with the 95% confidence interval.

FIG. 15|Insertion or deletion mutations induced by the VQR SpCas9 variant at endogenous zebrafish sites containing NGAG PAMs. For each target locus, the wild-type sequence is shown at the top with the protospacer highlighted in yellow (highlighted in green if present on the complementary strand) and the PAM is marked as red underlined text. Deletions are shown as red dashes highlighted in gray and insertions as lower case letters highlighted in blue. The net change in length caused by each indel mutation is shown on the right (+, insertion; –, deletion). Note that some alterations have both insertions and deletions of sequence and in these instances the alterations are enumerated in parentheses. The number of times each mutant allele was recovered (if more than once) is shown in brackets.

FIGS. 16A-B|Endogenous genes targeted by wild-type and evolved variants of SpCas9. A, Sequences targeted by wild-type, VQR, and VRER SpCas9 are shown in blue, red, and green, respectively. Sequences of sgRNAs and primers used to amplify these loci for T7E1 are provided in Tables 1 and 2, below. B, Mean mutagenesis frequencies detected by T7E1 for wild-type SpCas9 at eight target sites bearing NGG PAMs in the four different endogenous human genes (corresponding to the annotations in the top panel). Error bars represent s.e.m., n=3.

Figure 17A:
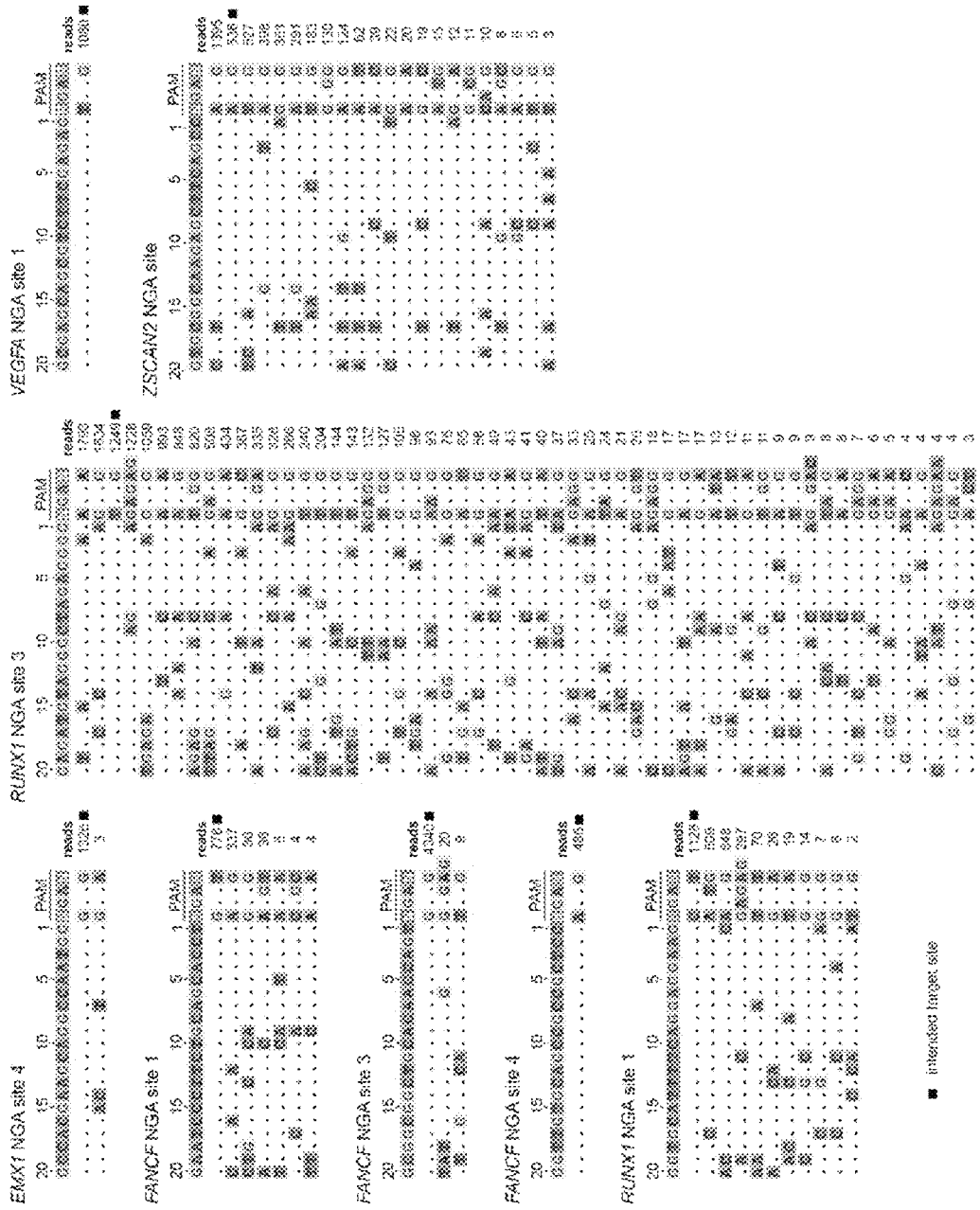
Figure 17B:
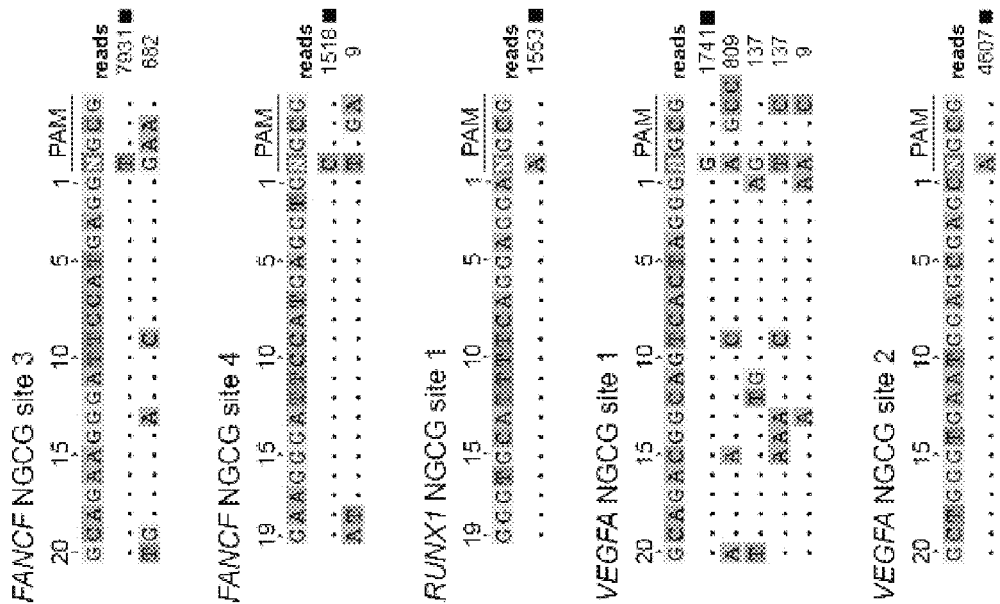

FIGS. 17A-B|Specificity profiles of the VQR and VRER SpCas9 variants determined using GUIDE-seq. The intended on-target site is marked with a black square, and mismatched positions within off-target sites are highlighted. A, The specificity of the VQR variant was assessed in human cells by targeting endogenous sites containing NGA PAMs: EMX1 site 4 (SEQ ID NO:142 and variants disclosed as SEQ ID NOS 691-692, respectively, in order of appearance), FANCF site 1 (SEQ ID NO:143 and variants disclosed as SEQ ID NOS 693-699, respectively, in order of appearance), FANCF site 3 (SEQ ID NO:144 and variants disclosed as SEQ ID NOS 700-702, respectively, in order of appearance), FANCF site 4 (SEQ ID NO:145 and variant disclosed as SEQ ID NO: 703), RUNX1 site 1 (SEQ ID NO:146 and variants disclosed as SEQ ID NOS 704-714, respectively, in order of appearance), RUNX1 site 3 (SEQ ID NO:147 and variants disclosed as SEQ ID NOS 715-771, respectively, in order of appearance), VEGFA site 1 (SEQ ID NO:148 and variant disclosed as SEQ ID NO: 772), and ZSCAN2 (SEQ ID NO:149 and variants disclosed as SEQ ID NOS 773-794, respectively, in order of appearance). B, The specificity of the VRER variant was assessed in human cells by targeting endogenous sites containing NGCG PAMs: FANCF site 3 (SEQ ID NO:150 and variants disclosed as SEQ ID NOS 795-796, respectively, in order of appearance), FANCF site 4 (SEQ ID NO:151 and variants disclosed as SEQ ID NOS 797-798, respectively, in order of appearance), RUNX1 site 1 (SEQ ID NO:152 and variant disclosed as SEQ ID NO: 799), VEGFA site 1 (SEQ ID NO:153 and variants disclosed as SEQ ID NOS 800-804, respectively, in order of appearance), and VEGFA site 2 (SEQ ID NO:154 and variant disclosed as SEQ ID NO: 805).

FIGS. 18A-C|Activity differences between D1135E and wild-type SpCas9 at off-target sites detected by GUIDE-seq. A, Mean frequency of oligo tag integration at the on-target sites, estimated by restriction fragment length polymorphism analysis. Error bars represent s.e.m., n=4. B, Mean mutagenesis frequencies at the on-target sites detected by T7E1. Error bars represent s.e.m., n=4. C, GUIDE-seq read-count differences between wild-type SpCas9 and D1135E at 3 endogenous human cell sites (EMX1 site 3 (SEQ ID NO:155 and variants disclosed as SEQ ID NOS 806-812, respectively, in order of appearance); ZNF629 site (SEQ ID NO:156 and variants disclosed as SEQ ID NOS 813-826, respectively, in order of appearance), VEGFA site 3 (SEQ ID NO:157 and variants disclosed as SEQ ID NOS 827-873, respectively, in order of appearance). The on-target site is shown at the top and off-target sites are listed below with mismatches highlighted. In the table, a ratio of off-target activity to on-target activity is compared between wild-type and D1135E to calculate the normalized fold-changes in specificity (with gains in specificity highlighted in green). For sites without detectable GUIDE-seq reads, a value of 1 has been assigned to calculate an estimated change in specificity (indicated in orange). Off-target sites analyzed by deep-sequencing in FIG. 3E are numbered to the left of the EMX1 site 3 and VEGFA site 3 off-target sites.

FIGS. 19A-F|Additional PAMs for St1Cas9 and SaCas9 and activities based on spacer lengths in human cells. A, PPDV scatterplots for St1Cas9 comparing the sgRNA complementarity lengths of 20 and 21 nucleotides obtained with a randomized PAM library for spacer 1 (top panel) or spacer 2 (bottom panel). PAMs were grouped and plotted by their 3rd/4th/5th/6th positions ("nnAGAA" disclosed as SEQ ID NO: 3). The red dashed line indicates PAMs that are statistically significantly depleted (see FIG. 13C) and the gray dashed line represents five-fold depletion (PPDV of 0.2). B, Table of PAMs with PPDVs of less than 0.2 for St1Cas9 under each of the four conditions tested. PAM numbering shown on the left is the same as in FIG. 4A (PAM 1 disclosed as SEQ ID NO: 3). C, PPDV scatterplots for SaCas9 comparing the sgRNA complementarity lengths of 21 and 23 nucleotides obtained with a randomized PAM library for spacer 1 (top panel) or spacer 2 (bottom panel). PAM were grouped and plotted by their 3rd/4th/5th/6th positions. The red and gray dashed lines are the same as in (A). D, Table of PAMs with PPDVs of less than 0.2 for SaCas9 under each of the four conditions tested. PAM numbering is the same as in FIG. 4B ("nnGGGT" disclosed as SEQ ID NO: 4, "nnGAAT" disclosed as SEQ ID NO: 6, "nnGAGT" disclosed as SEQ ID NO: 5, "nnAAGT" disclosed as SEQ ID NO 41, "nnAGGT" disclosed as SEQ ID NO: 42 and "nnCAGT" disclosed as SEQ ID NO: 511). E, F, Human cell activity of St1Cas9 and SaCas9 across various spacer lengths via EGFP disruption (panel E, data from FIGS. 4D, 4E) and endogenous gene mutagenesis detected by T7E1 (panel F, data from FIGS. 4F, 4G). Activity for all replicates shown (n=3 or 4); bars illustrate mean and 95% confidence interval; number of sites per spacer length indicated.

FIGS. 20A-B|Structural and functional roles of D1135, G1218, and T1337 in PAM recognition by SpCas9. A, Structural representations of the six residues implicated in PAM recognition. The left panel illustrates the proximity of D1135 to S1136, a residue that makes a water-mediated, minor groove contact to the 3rd base position of the PAM15. The right panel illustrates the proximity of G1218, E1219, and T1337 to R1335, a residue that makes a direct, base-specific major groove contact to the 3rd base position of the PAM15. Angstrom distances indicated by yellow dashed lines; non-target strand guanine bases dG2 and dG3 of the PAM are shown in blue; other DNA bases shown in orange; water molecules shown in red; images generated using PyMOL from PDB:4UN3. B, Mutational analysis of six residues in SpCas9 that are implicated in PAM recognition. Clones containing one of three types of mutations at each position were tested for EGFP disruption with two sgRNAs targeted to sites harboring NGG PAMs. For each position, we created an alanine substitution and two non-conservative mutations. S1136 and R1335 were previously reported to mediate contacts to the 3rd guanine of the PAM15, and D1135, G1218, E1219, and T1337 are reported in this study. EGFP disruption activities are quantified by flow cytometry; background control represented by the dashed red line; error bars represent s.e.m., n=3.

FIGS. 21A-F Selection and assembly of SaCas9 variants with altered PAM specificities (A) Phylogenetic tree of Cas9 orthologues with SpCas9 and SaCas9 highlighted. (B) Activity of SaCas9 variants with single amino acid substitutions assessed in the bacterial positive selection assay (see also FIG. 31B). Error bars represent s.e.m., n=3; NS=no survival. (C) Human cell activity of wild-type and R1015H SaCas9 (SEQ ID NOS 41, 511, 5 and 513, respectively, in order of appearance). EGFP disruption activity quantified by flow cytometry; error bars represent s.e.m, n=3, mean level of background EGFP loss represented by dashed red line (for this and panel E). (D) Total number of substitutions observed at each amino acid position when selecting for SaCas9 variants with altered PAM specificities (SEQ ID NOS 43 and 47, respectively, in order of appearance). Starter mutations at R1015 are not counted. (E) Human cell EGFP disruption activity of variants containing mutations observed when selecting for altered PAM specificities (SEQ ID NOS 41, 5, 42, 4 and 511, 513, 512 and 514, respectively, in order of appearance). (F) Mean post-selection PAM depletion value (PPDV) scatterplot of wild-type SaCas9 versus the KKH variant (n=2, see also FIG. 34C) (SEQ ID NOS 43, 47, 46, 48, 514, 513, 6, 4, 42, 512, 5, 41 and 511, respectively, in order of appearance). Two libraries with different protospacers and 8 randomized basepairs in place of the PAM were used to determine which PAMs are targetable by each Cas9. Statistically significant depletion indicated by the red dashed line (relative to a dCas9 control, see FIGS. 34A and 34B), and 5-fold depletion by the grey dashed line.

FIGS. 22A-F. Activity of the SaCas9 KKH variant targeted to endogenous sites in human cells (A) Mutagenesis frequencies across 55 different sites bearing NNNRRT PAMs (SEQ ID NOS 43, 47, 46 and 48, respectively, in order of appearance) induced by KKH SaCas9, determined by T7E1 assay. Error bars represent s.e.m., n=3, ND, not detectable by T7E1 assay. (B) KKH variant preference for the third position of the PAM. Mean activities from data in panel A are shown for this and panels B and C. (C) KKH variant preference for the fourth and fifth positions of the PAM. (D) Spacer length preference of the KKH SaCas9 variant. (E) Comparison of the human cell EGFP disruption activity of wild-type and KKH SaCas9 targeted to various sites containing NNNRRT PAMs (SEQ ID NOS 43, 47, 46 and 48, respectively, in order of appearance). EGFP disruption quantified by flow cytometry; error bars represent s.e.m, n=3, mean level of background EGFP loss represented by dashed red line. (F) Mutagenesis frequencies of wild-type SaCas9 against one site for each of the 16 possible NNNRRT sites from panel A (sites with the highest KKH activity were selected). Error bars represent s.e.m., n=3, ND, not detectable by T7E1 assay.

FIGS. 23A-E Genome-wide specificity profiles of wild-type and KKH SaCas9 (A) and (B) Direct comparison of wild-type and KKH SaCas9 targeted to sites containing NNGRRT (SEQ ID NO:46) PAMs, represented by total number of off-targets (panel A) and mismatches observed at each off-target site (panel B) at EMX site 6 (SEQ ID NO:158 and variants disclosed as SEQ ID NOS 874-876, respectively, in order of appearance) and VEGF site 8 (SEQ ID NO:159 and variants disclosed as SEQ ID NOS 891-925, respectively, in order of appearance). FANCF site 10 wild-type and variants disclosed as SEQ ID NOS 877 and 878; FANCF site 13 wildtype and variants disclosed as SEQ ID NOS 879-883; RUNX1 site 13 wildtype and variants disclosed as SEQ ID NOS 884-887; and RUNX1 site 14 variants disclosed as SEQ ID NOS 888-890, all respectively, in order of appearance). For panels B and E, GUIDE-seq read counts at each site are indicated; on-target sequences are marked with a black box; mismatched positions within off-target sites are highlighted; sequences have been corrected for cell-type specific SNPs; sites with potential sgRNA or DNA bulge nucleotides are indicated by a small red-bordered base or a dash, respectively. (C) Venn diagram highlighting the differences in off-target site cleavage by wild-type and KKH SaCas9 at VEGFA site 8. (D) and (E) Specificity profile of the KKH variant targeted to sites containing NNHRRT (SEQ ID NO:44) PAMs, EMX site 1 (SEQ ID NO:160 and variants disclosed as SEQ ID NOS 926-941, respectively, in order of appearance), EMX site 4 (SEQ ID NO:161 and variants disclosed as SEQ ID NOS 942-951, respectively, in order of appearance), EMX site 10 (SEQ ID NO:162 and variants disclosed as SEQ ID NOS 952-957, respectively, in order of appearance), FANCF site 9 (SEQ ID NO:163 and variants disclosed as SEQ ID NOS 958-962, respectively, in order of appearance), and FANCF site 16 (SEQ ID NO:164 and variant disclosed as SEQ ID NO: 963), represented by total number of off-targets (panel D) and mismatches observed at each off-target site (panel E).

Figure 24:
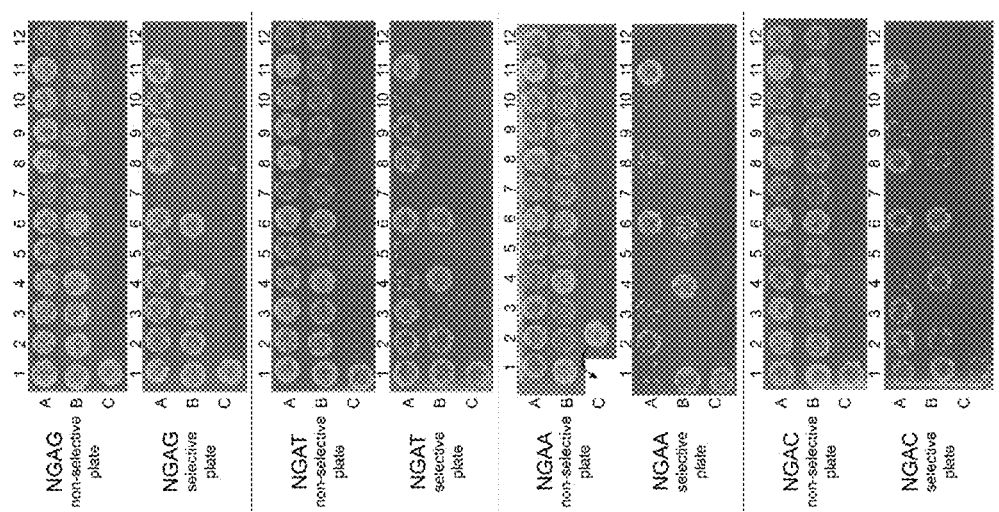

FIG. 24: Activity of VQR-derivative clones in the bacterial 2-plasmid screen. Testing of 24 different VQR derivative variants against sites in bacteria that contain NGAN PAMs. Survival on the selective plate, relative to the non-selective plate, is indicative of activity against the indicated PAM.

Figure 25:
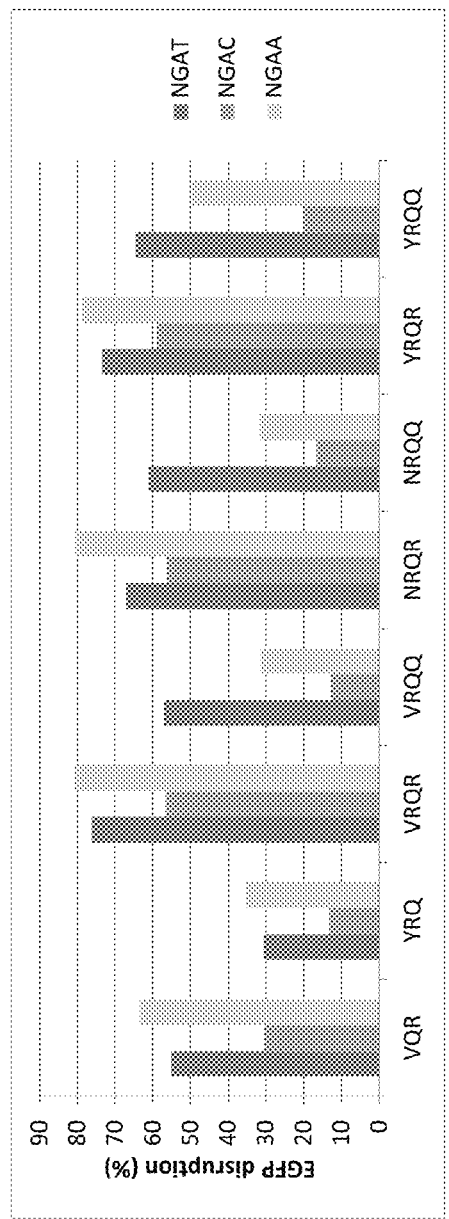

FIG. 25: Human cell EGFP disruption activity of SpCas9-VQR derivatives. EGFP disruption activity of the SpCas9 variants is a measure of activity against sites that contain the indicated PAM.

Figure 26:
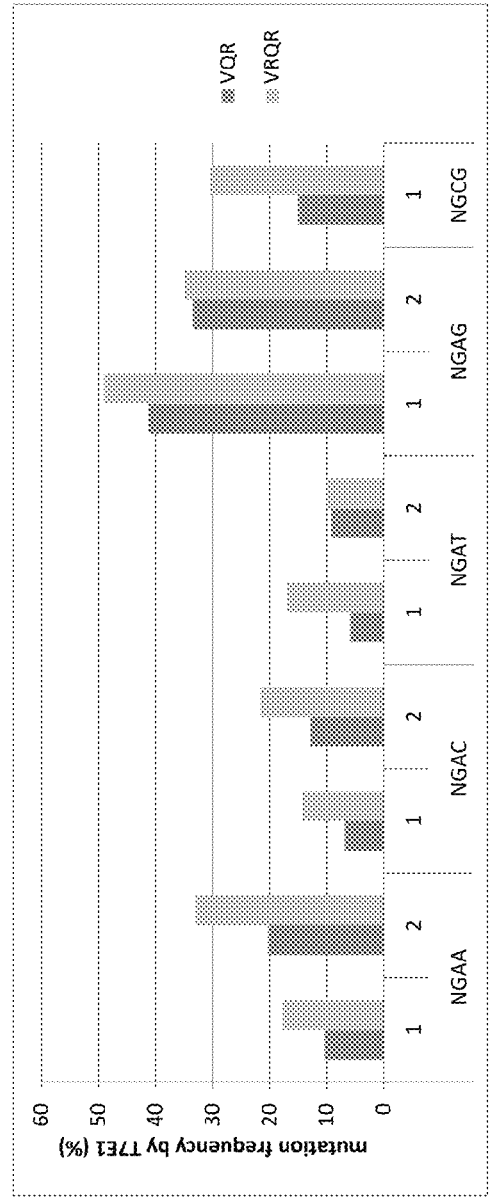

FIG. 26: Human cell EGFP disruption activity of SpCas9-VQR and -VRQR variants. EGFP disruption activity of the SpCas9 variants is a measure of activity against sites that contain the indicated PAM.

Figure 27:
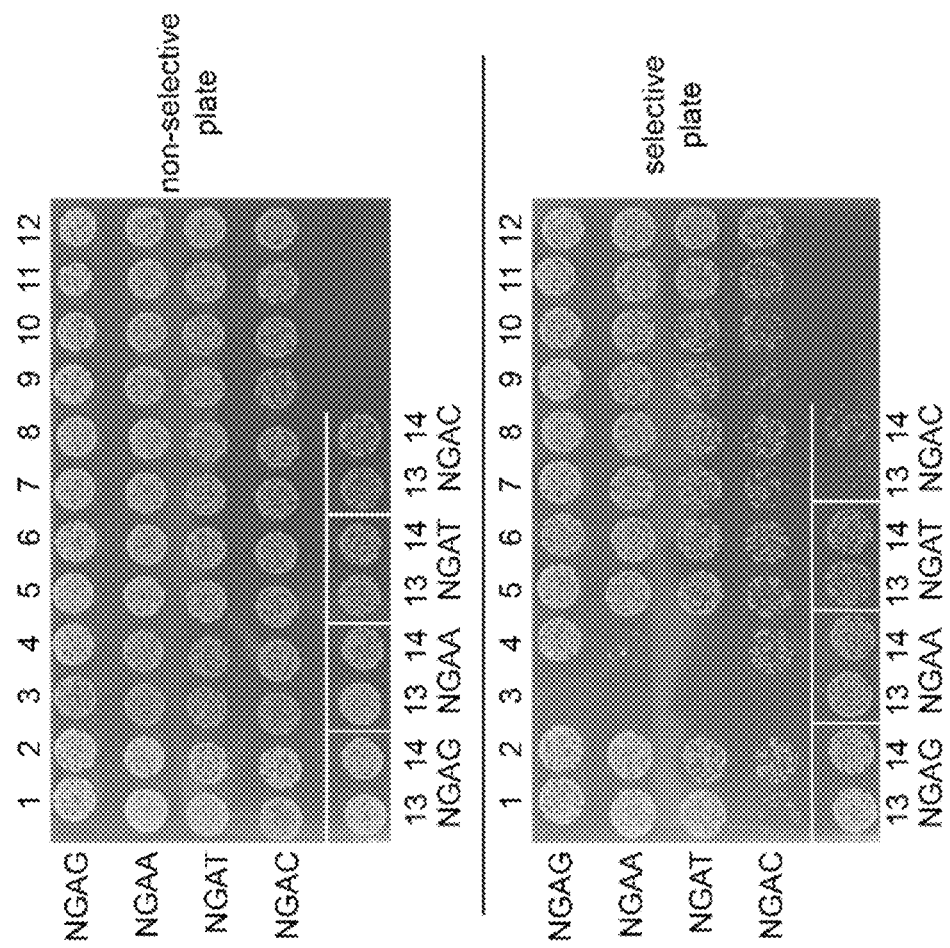

FIG. 27: Activity of SpCas9-VRQR derivate variants in the bacterial 2-plasmid screen. Testing of 12 different VQR derivative variants against sites in bacteria that contain NGAN PAMs, compared to the VQR and VRQR variants. Survival on the selective plate, relative to the non-selective plate, is indicative of activity against the indicated PAM.

Figure 28:
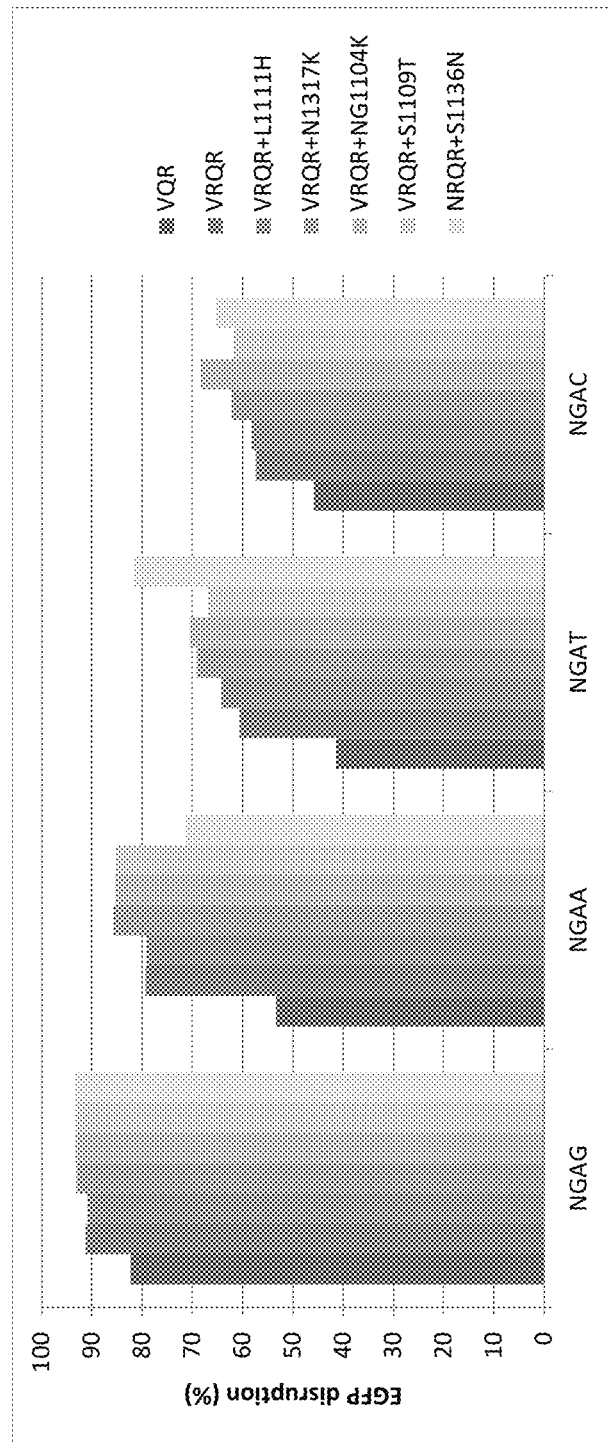

FIG. 28: Human cell EGFP disruption activity of SpCas9-VRQR variants. EGFP disruption activity of the SpCas9 variants is a measure of activity against sites that contain the indicated PAM.

Figure 29:
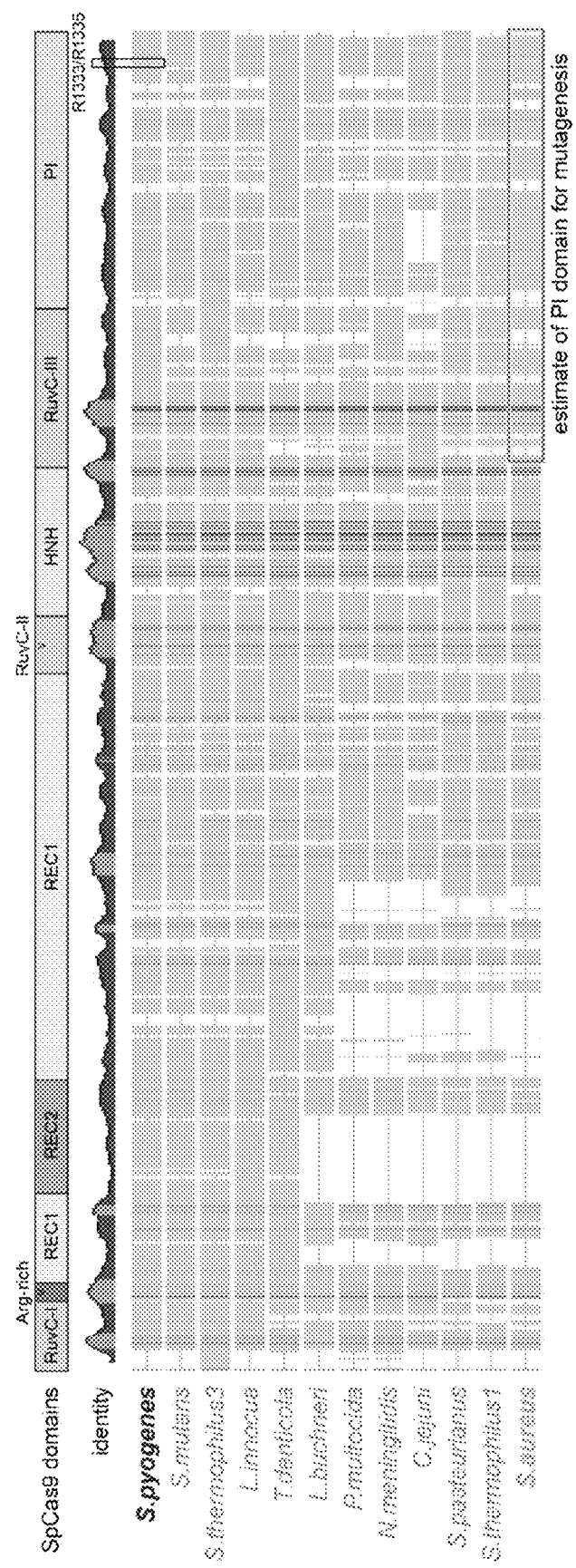

FIG. 29 Protein domain alignment of Cas9 orthologues (from FIG. 21A). The domain structure of SpCas9 is shown at the top (based on PDB:4UN3; Anders et al., 2014); the PAM contacting residues of SpCas9 are highlighted; the region of SaCas9 mutagenized to select for altered PAM specificity variants is shown.

Figure 30A:
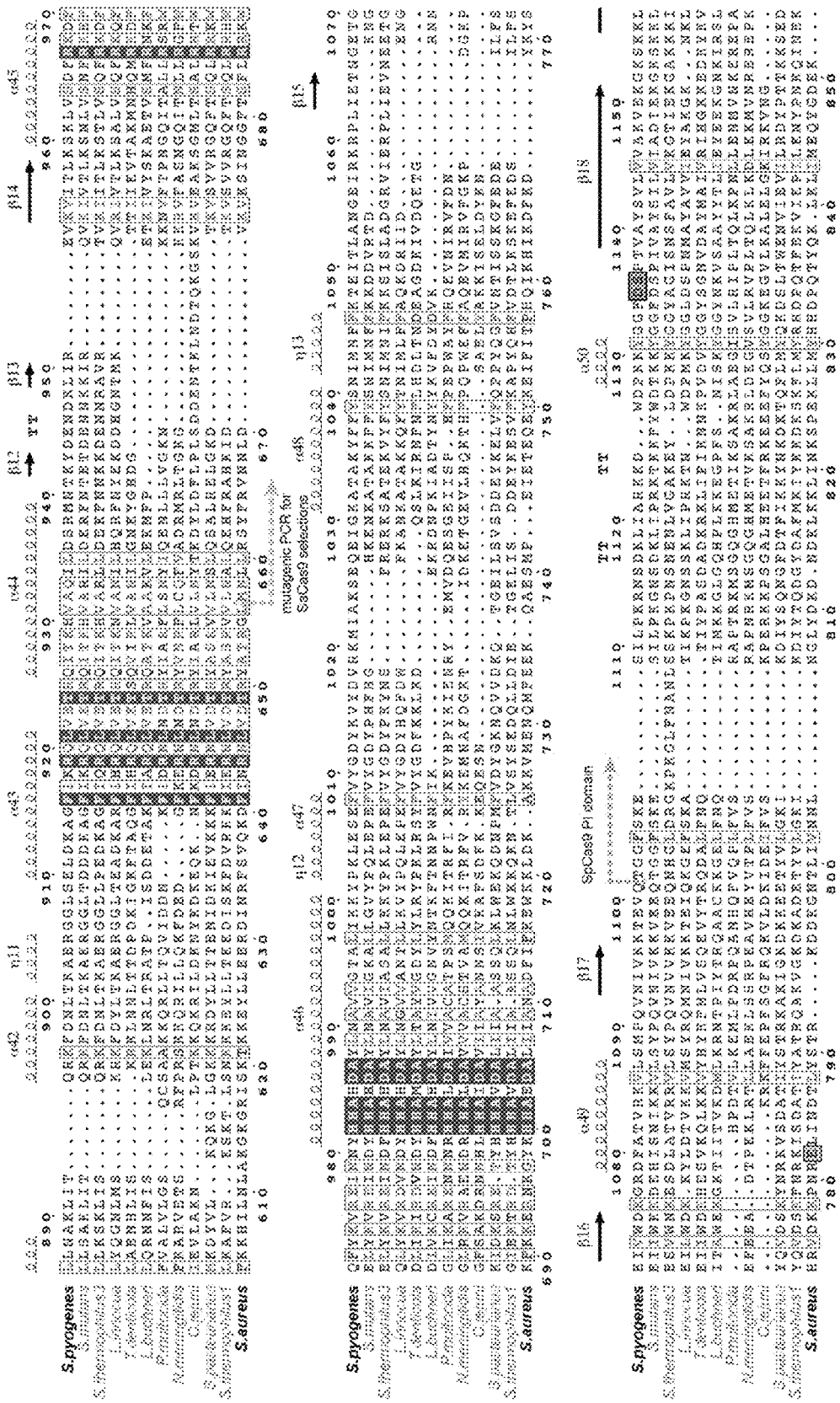
Figure 30B:
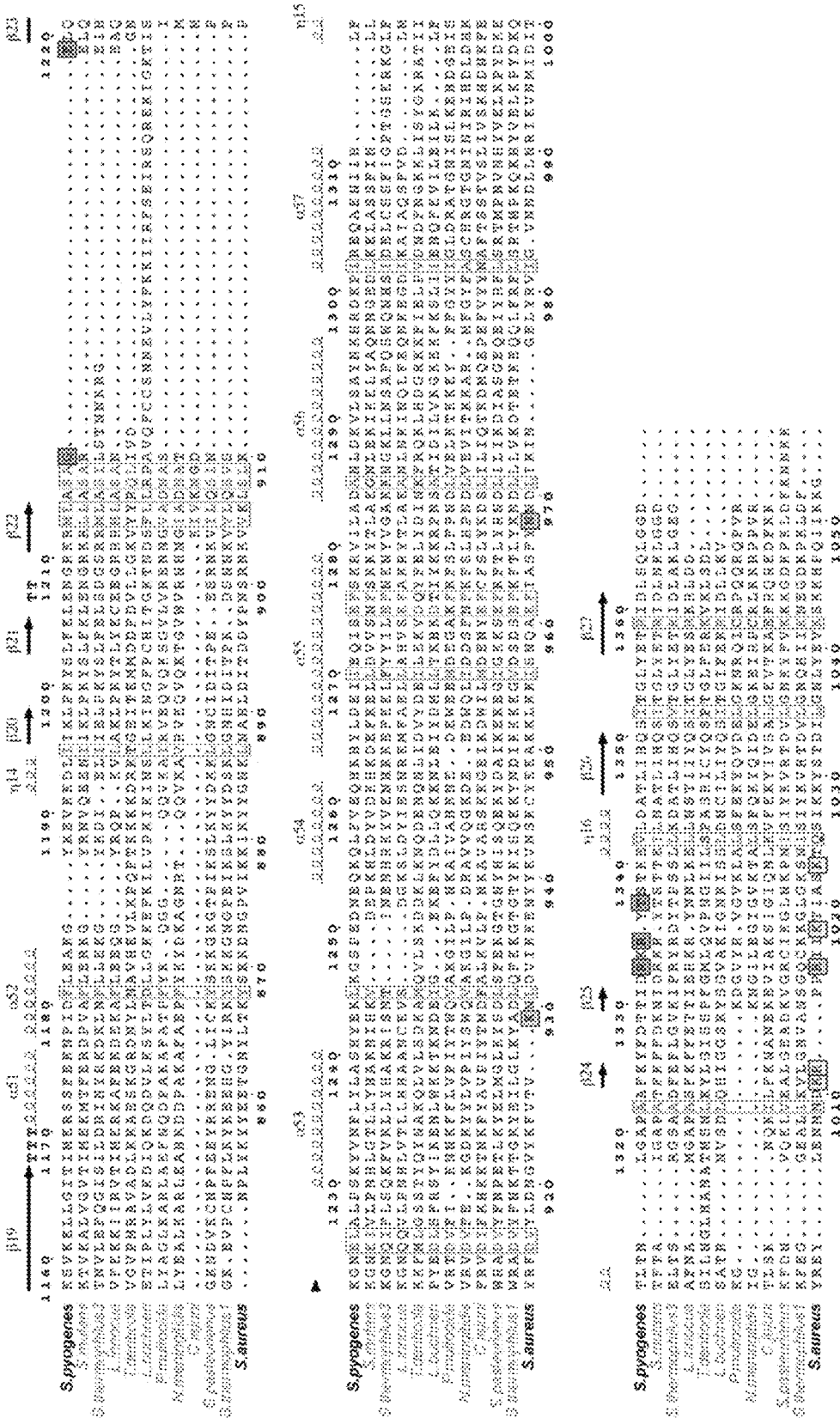

FIGS. 30A-B Primary sequence alignment of Cas9 orthologues for identification of PAM-interacting residues; SEQ ID NOs:165-176, respectively. SpCas9 residues previously identified (Anders et al., 2014; Examples 1-2) to be important for contacting the PAM are highlighted in blue, residues capable of modulating SaCas9 PAM specificity (identified in this study) are highlighted in orange, and positively charged residues adjacent to R1015 are highlighted in yellow. The structurally predicted PAM-interacting domain of SpCas9 is highlighted with a blue dashed line (based on PDB:4UN3; Anders et al., 2014), and the conservative estimate of the SaCas9 PAM-interacting domain used as a boundary for PCR mutagenesis is indicated with an orange dashed line.

Figure 31A:
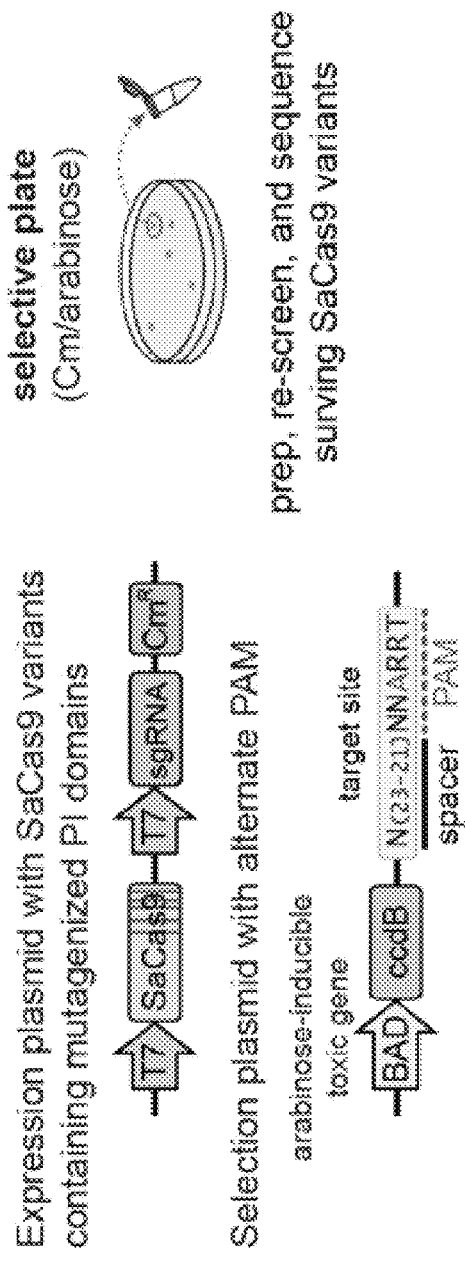
Figure 31B:
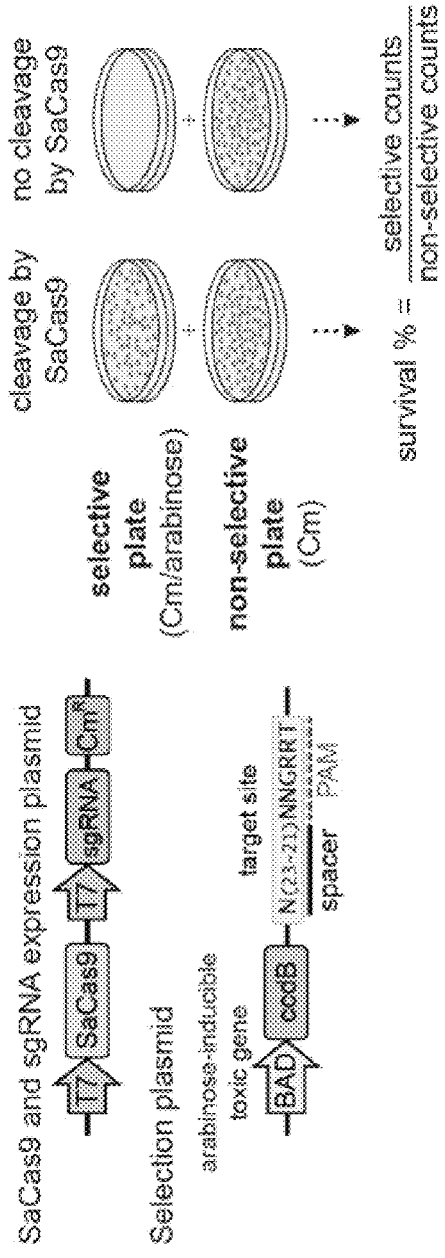

FIGS. 31A-B Schematic of the bacterial positive selection assay (A) The selection plasmids can be modified to screen for Cas9 variants that are able to recognize alternative PAM sequences (SEQ ID NO: 1020). (B) Schematic of the positive selection plasmids (left panel) and expected outcomes (right panel) when screening functional or non-functional Cas9/sgRNA pairs in the positive selection (SEQ ID NO: 1021).

Figure 32:
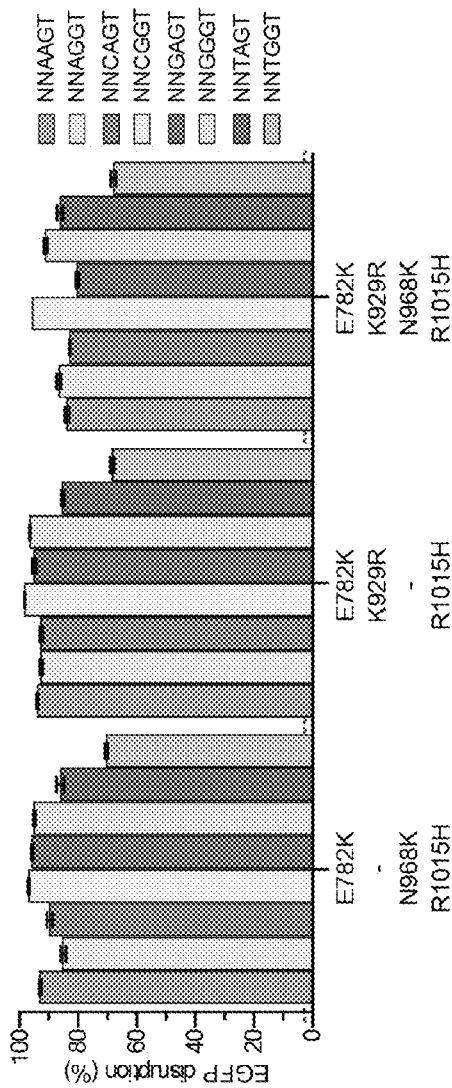

FIG. 32 Addition of the K929R mutation to the KNH and KKH variants (SEQ ID NOS 41-42, 511-512, 5, 4 and 513-514, respectively, in order of appearance). EGFP disruption activity quantified by flow cytometry; error bars represent s.e.m, n=3, mean level of background EGFP loss represented by the dashed red line.

Figure 33:
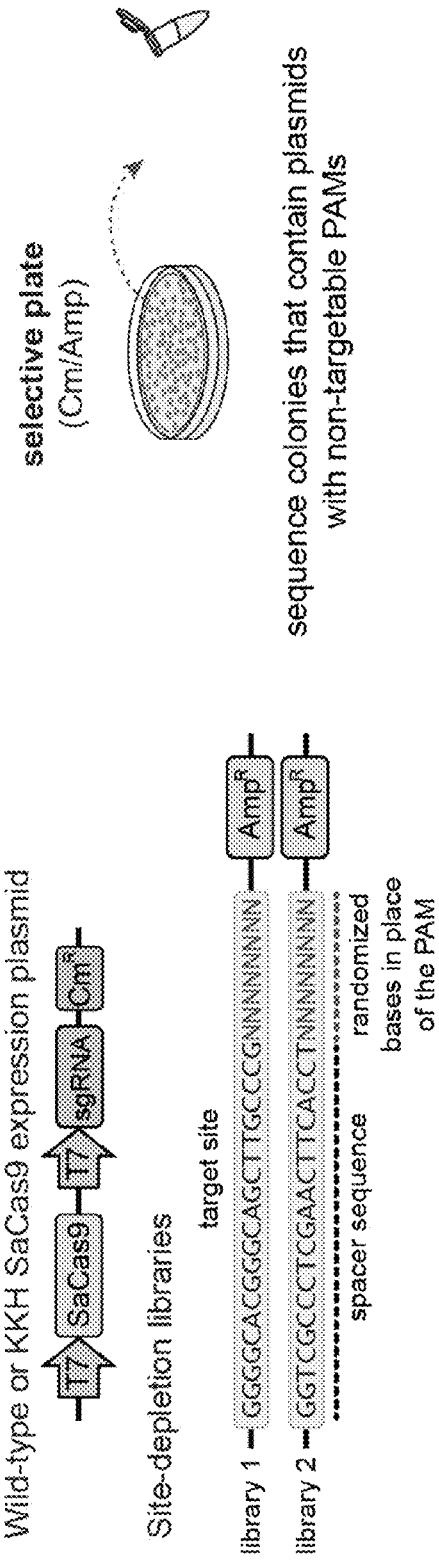

FIG. 33 Schematic of the bacterial site-depletion assay. Site-depletion plasmids with 8 randomized nucleotides in place of the PAM that are refractory to cleavage by wild-type or KKH SaCas9 are sequenced. Library 1 Spacer sequence, SEQ ID NO:964; library 2 spacer sequence, SEQ ID NO: 965. Targetable PAMs are inferred by their depletion relative to the input library, calculated as the post-selection PAM depletion value (PPDV).

FIGS. 34A-E Site-depletion assay results for wild-type and KKH SaCas9 (A) PPDV values for dCas9 control experiments on both libraries. The red dashed line indicates statistical significance (PPDV=0.794, see panel B); grey dashed line indicates 5-fold depletion; PPDVs for a window comprising the $3^{rd}/4^{th}/5^{th}/6^{th}$ positions of the PAM are plotted (for this and panel C). (B) Statistically significant post-selection PAM depletion values (PPDVs) were determined from the dCas9 control experiments in panel A. Statistical significance was determined by setting the threshold at 3.36 times the standard deviation. (C) Comparison of the PPDVs for wild-type and KKH SaCas9 for each of the two libraries containing 8 randomized nucleotides in place of the PAM. Library 1 discloses SEQ ID NOS 514, 513, 6, 4, 42, 512, 5, 511 and 41, and Library 2 discloses SEQ ID NOS 513-514, 5-6, 4, 42, 41 and 511-512, respectively, in order of appearance. (D) and (E) PAMs and corresponding PPDV values for all PAMs depleted greater than 5-fold for wild-type and KKH SaCas9, respectively. Sequence motifs are shown for PAMs in two categories: 1) greater than 10 fold or 2) 5- to 10-fold depleted.

FIGS. 35A-D Additional characteristics of endogenous sites targeted by KKH SaCas9 (A) Activity for each of the 55 endogenous site sgRNAs, binned based on the 16 possible NRR motifs of an NNNRRT PAM. Mean activities from FIG. 2A are shown for this and panels B and C. (B) and (C) Relationship between endogenous gene disruption activity and GC content of the spacer and PAM, respectively. (D) Sequence logos for the spacer and PAM of target sites binned based on activity. Sites were grouped based on mean mutation frequency (from FIG. 2A) into low (0-10%, 17 sites), medium (10-30%, 17 sites), or high (>30%, 21 sites) activity.

Figures 36A, 36B:
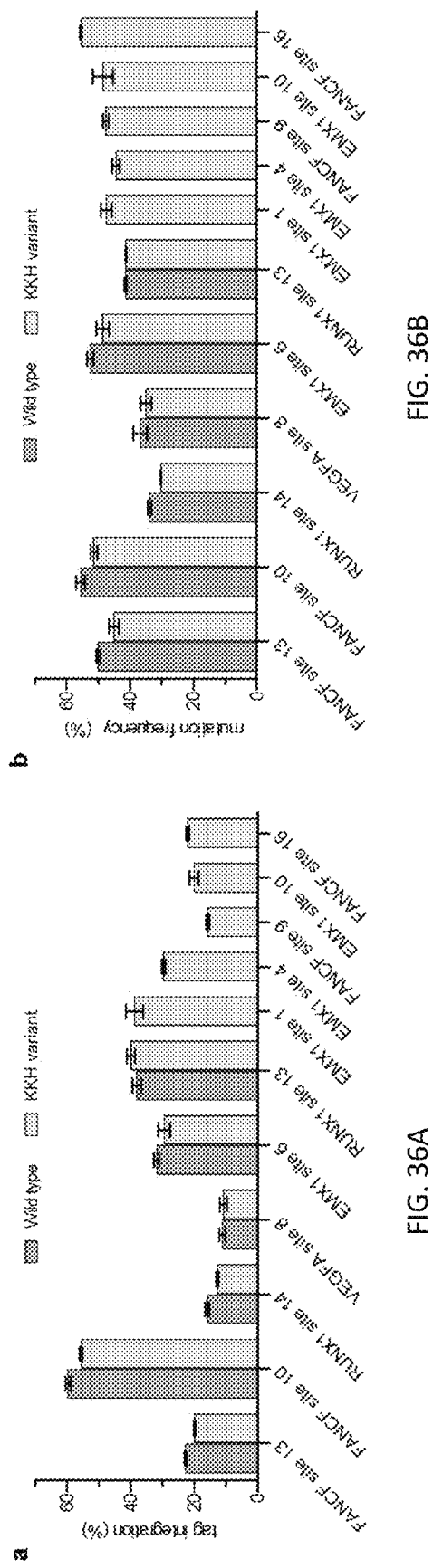

FIGS. 36A-B On-target tag integration and mutagenesis frequencies for GUIDE-seq experiments (A) Restriction fragment length polymorphism (RFLP) analysis to determine the mean GUIDE-seq tag integration frequencies. Error bars represent s.e.m., n=3 (for this and panel B). (B) Mean mutagenesis detected by T7E1 assay.

Figure 37A:
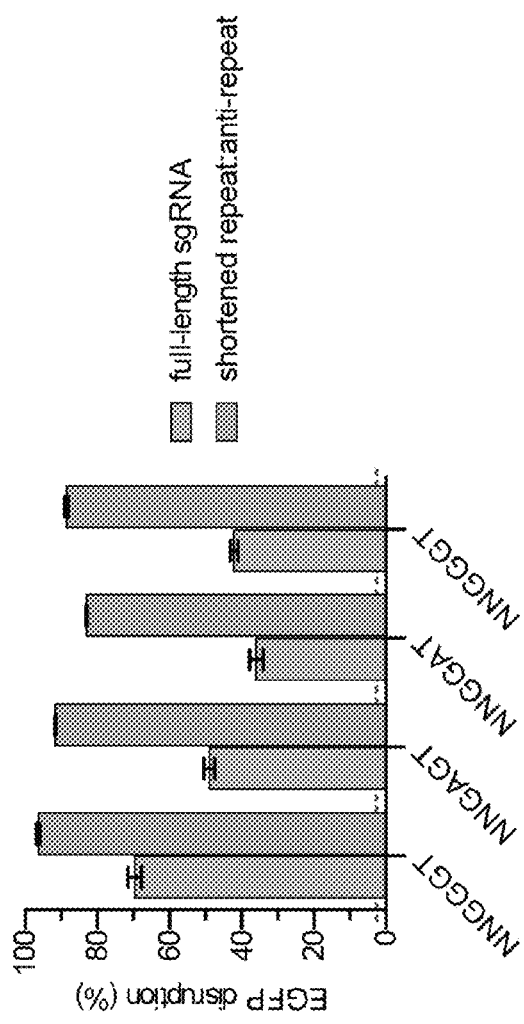
Figure 37B:
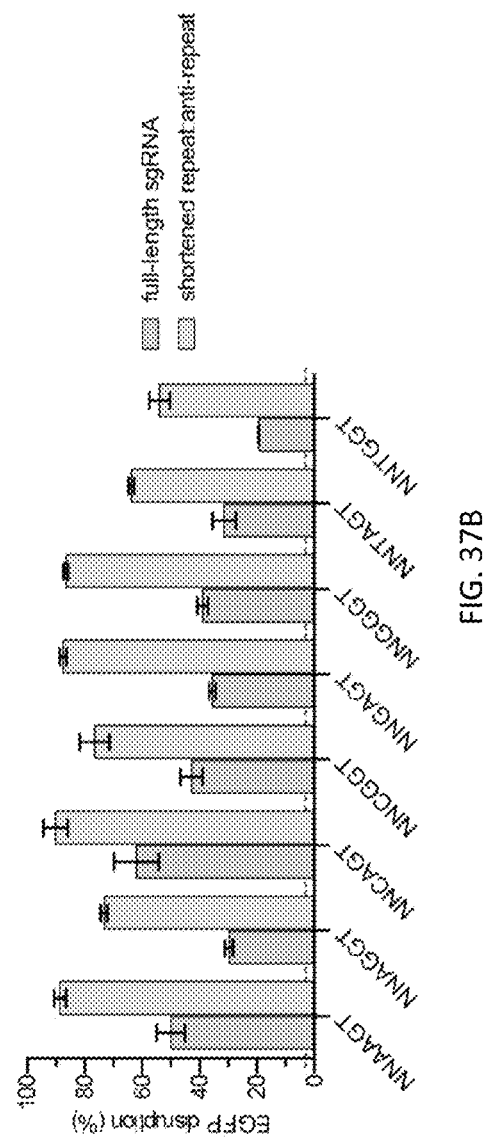

FIGS. 37A-B A truncated repeat: anti-repeat sgRNA outperforms the full length sgRNA, similar to previous results (Ran et al., 2015) (A) Human cell EGFP disruption activity for wild-type SaCas9 against 4 sites that contain NNGRRT (SEQ ID NO:46) PAMs (SEQ ID NOS 4, 5 and 4, respectively, in order of appearance). EGFP disruption activity quantified by flow cytometry; error bars represent s.e.m, n=3, mean level of background EGFP loss represented by dashed red line (for this and panel B). (B) Human cell EGFP disruption activity for KKH SaCas9 against 8 sites that contain NNNRRT PAMs (SEQ ID NOS 41-42, 511-512, 5, 4 and 513-514, respectively, in order of appearance).

DETAILED DESCRIPTION

Although CRISPR-Cas9 nucleases are widely used for genome editing[1-4], the range of sequences that Cas9 can cleave is constrained by the need for a specific protospacer adjacent motif (PAM) in the target site[5,6]. For example, SpCas9, the most robust and widely used Cas9 to date, primarily recognizes NGG PAMs. As a result, it can often be difficult to target double-stranded breaks (DSBs) with the precision that is necessary for various genome editing applications. In addition, imperfect PAM recognition by Cas9 can lead to the creation of unwanted off-target mutations[7,8]. The ability to evolve Cas9 derivatives with purposefully altered or improved PAM specificities would address these limitations but, to the present inventors' knowledge, no such Cas9 variants have been described.

A potential strategy for improving the targeting range of orthogonal Cas9s that recognize extended PAMs is to alter their PAM recognition specificities. As described herein, PAM recognition specificity of SpCas9 can be altered using a combination of structure-guided design and directed evolution performed with a bacterial cell-based selection system; see Examples 1 and 2. Also described herein are variants that have been evolved to have relaxed or partially relaxed specificities for certain positions within the PAM; see Example 3. These variants expand the utility of Cas9 orthologues that specify longer PAM sequences.

Engineered Cas9 Variants with Altered PAM Specificity

The SpCas9 variants engineered in this study greatly increase the sites accessible by wild-type SpCas9, further enhancing the opportunities to use the CRISPR-Cas9 platform to practice efficient HDR, to target NHEJ-mediated indels to small genetic elements, and to exploit the requirement for a PAM to distinguish between two different alleles in the same cell. The altered PAM specificity SpCas9 variants can efficiently disrupt endogenous gene sites that are not currently targetable by SpCas9 in both zebrafish embryos and human cells, suggesting that they will work in a variety of different cell types and organisms. Importantly, GUIDE-seq experiments show that the global profiles of the VQR and VRER SpCas9 variants are similar to or better than those observed with wild-type SpCas9. In addition, the improved specificity D1135E variant that we identified and characterized provides a superior alternative to the widely used wild-type SpCas9. D1135E has similar activity to wild-type SpCas9 on sites with canonical NGG PAMs but reduces genome-wide cleavage of off-target sites bearing mismatched spacer sequences and either canonical or non-canonical PAMs.

All of the SpCas9 and SaCas9 variants described herein can be rapidly incorporated into existing and widely used vectors, e.g., by simple site-directed mutagenesis, and because they require only a small number of mutations contained within the PAM-interacting domain, the variants should also work with other previously described improvements to the SpCas9 platform (e.g., truncated sgRNAs (Tsai et al., Nat Biotechnol 33, 187-197 (2015); Fu et al., Nat Biotechnol 32, 279-284 (2014)), nickase mutations (Mali et al., Nat Biotechnol 31, 833-838 (2013); Ran et al., Cell 154, 1380-1389 (2013)), dimeric FokI-dCas9 fusions (Guilinger et al., Nat Biotechnol 32, 577-582 (2014); Tsai et al., Nat Biotechnol 32, 569-576 (2014)).

Beyond the mutations to R1335 that presumably contact the 3rd PAM base position, the SpCas9 variants evolved in this study bear amino acid substitutions at D1135, G1218, and T1337, all of which are located near or adjacent to residues that make direct or indirect contacts to the 3rd PAM position in the SpCas9-PAM structure but do not themselves mediate contacts with the PAM bases (Anders et al., Nature 513, 569-573 (2014)) (FIG. 20A). Consistent with this, we found that various mutations at these positions do not appear to affect SpCas9-mediated cleavage of sites bearing an NGG PAM (FIG. 20B). These results, together with the nature of the amino acid substitutions at G1218 and T1337 in the VQR and VRER SpCas9 variants, suggest that alterations at these two positions may be gain-of-function mutations. For example, it is possible that the T1337R mutation is forming backbone or base-specific contacts near or to the $4^{th}$ position of the PAM, particularly in the case of the VRER variant. The mechanistic role of mutations at D1135 remain less clear but they may perhaps influence the activity of the adjacent S1136 residue, which has been implicated in making a water-mediated contact through the minor groove to the guanine in the third position of the PAM (Anders et al., Nature 513, 569-573 (2014)). The D1135E mutation might improve specificity by disrupting this network, perhaps reducing the overall interaction energy of the SpCas9/gRNA complex with the target site, a mechanism we have previously proposed might reduce off-target effects by making cleavage of these unwanted sequences less energetically favorable (Fu et al., Nat Biotechnol 32, 279-284 (2014)).

The present results clearly establish the feasibility of engineering Cas9 nucleases with altered PAM specificities. Characterization of additional Cas9 orthologues (Esvelt et al., Nat Methods 10, 1116-1121 (2013); Fonfara et al., Nucleic Acids Res 42, 2577-2590 (2014)) or generation of domain-swapped Cas9 chimeras (Nishimasu et al., Cell. 156(5):935-49 (2014)) as previously described also provide potential avenues for targeting different PAMs. The engineering strategy delineated herein can also be performed with such orthologues or synthetic hybrid Cas9s to further diversify the range of targetable PAMs. St1Cas9 and SaCas9 make particularly attractive frameworks for future engineering efforts given their smaller sizes relative to SpCas9 and our demonstration of their robust genome editing activities in our bacterial selection systems and in human cells.

Our results strongly suggested that R1015 in wild-type SaCas9 contacts the G in the third PAM position. Without wishing to be bound by theory, the R1015H substitution may remove this contact and relax specificity at the third position; however, loss of the R1015 to G contact could also conceivably reduce the energy associated with target site binding, which may explain why the R1015H mutation alone is not sufficient for robust activity at NNNRRT sites in human cells. Because the E782K and N968K substitutions both add positive charge, it is possible that they may make non-specific interactions with the DNA phosphate backbone to compensate energetically for the loss of the R1015 to guanine contact.

The genetic approach described here does not require structural information and therefore should be applicable to many other Cas9 orthologues. The only requirement to evolve Cas9 nucleases with broadened PAM specificities is that they function in a bacterial-based selection. While previous studies demonstrated that PAM recognition can be altered by swapping the PAM-interacting domains of highly related Cas9 orthologues (Nishimasu et al., Cell (2014)), it remains to be determined whether this strategy is generalizable or effective when using more divergent orthologues. By contrast, the evolution strategies we have described herein can be used engineer PAM recognition specificities beyond those encoded within naturally occurring Cas9 orthologues. This overall strategy can be employed to expand the targeting range and extend the utility of the numerous Cas9 orthologues that exist in nature.

SpCas9 Variants with Altered Specificity

Thus, provided herein are spCas9 variants. The SpCas9 wild type sequence is as follows:

```
                                                          (SEQ ID NO: 1)
           10         20         30         40         50         60
    MDKKYSIGLD IGTNSVGWAV ITDEYKVPSK KFKVLGNTDR HSIKKNLIGA LLFDSGETAE 70         80         90        100        110        120
    ATRLKRTARR RYTRRKNRIC YLQEIFSNEM AKVDDSFFHR LEESFLVEED KKHERHPIFG 130        140        150        160        170        180
    NIVDEVAYHE KYPTIYHLRK KLVDSTDKAD LRLIYLALAH MIKFRGHFLI EGDLNPDNSD 190        200        210        220        230        240
    VDKLFIQLVQ TYNQLFEENP INASGVDAKA ILSARLSKSR RLENLIAQLP GEKKNGLFGN
```

```
        250        260        270        280        290        300
LIALSLGLTP NFKSNFDLAE DAKLQLSKDT YDDDLDNLLA QIGDQYADLF LAAKNLSDAI 310        320        330        340        350        360
LLSDILRVNT EITKAPLSAS MIKRYDEHHQ DLTLLKALVR QQLPEKYKEI FFDQSKNGYA 370        380        390        400        410        420
GYIDGGASQE EFYKFIKPIL EKMDGTEELL VKLNREDLLR KQRTFDNGSI PHQIHLGELH 430        440        450        460        470        480
AILRRQEDFY PFLKDNREKI EKILTFRIPY YVGPLARGNS RFAWMTRKSE ETITPWNFEE 490        500        510        520        530        540
VVDKGASAQS FIERMTNFDK NLPNEKVLPK HSLLYEYFTV YNELTKVKYV TEGMRKPAFL 550        560        570        580        590        600
SGEQKKAIVD LLFKTNRKVT VKQLKEDYFK KIECFDSVEI SGVEDRFNAS LGTYHDLLKI 610        620        630        640        650        660
IKDKDFLDNE ENEDILEDIV LTLTLFEDRE MIEERLKTYA HLFDDKVMKQ LKRRRYTGWG 670        680        690        700        710        720
RLSRKLINGI RDKQSGKTIL DFLKSDGFAN RNFMQLIHDD SLTFKEDIQK AQVSGQGDSL 730        740        750        760        770        780
HEHIANLAGS PAIKKGILQT VKVVDELVKV MGRHKPENIV IEMARENQTT QKGQKNSRER 790        800        810        820        830        840
MKRIEEGIKE LGSQILKEHP VENTQLQNEK LYLYYLQNGR DMYVDQELDI NRLSDYDVDH 850        860        870        880        890        900
IVPQSFLKDD SIDNKVLTRS DKNRGKSDNV PSEEVVKKMK NYWRQLLNAK LITQRKFDNL 910        920        930        940        950        960
TKAERGGLSE LDKAGFIKRQ LVETRQITKH VAQILDSRMN TKYDENDKLI REVKVITLKS 970        980        990       1000       1010       1020
KLVSDFRKDF QFYKVREINN YHHAHDAYLN AVVGTALIKK YPKLESEFVY GDYKVYDVRK 1030       1040       1050       1060       1070       1080
MIAKSEQEIG KATAKYFFYS NIMNFFKTEI TLANGEIRKR PLIETNGETG EIVWDKGRDF 1090       1100       1110       1120       1130       1140
ATVRKVLSMP QVNIVKKTEV QTGGFSKESI LPKRNSDKLI ARKKDWDPKK YGGFDSPTVA 1150       1160       1170       1180       1190       1200
YSVLVVAKVE KGKSKKLKSV KELLGITIME RSSFEKNPID FLEAKGYKEV KKDLIIKLPK 1210       1220       1230       1240       1250       1260
YSLFELENGR KRMLASAGEL QKGNELALPS KYVNFLYLAS HYEKLKGSPE DNEQKQLFVE 1270       1280       1290       1300       1310       1320
QHKHYLDEII EQISEFSKRV ILADANLDKV LSAYNKHRDK PIREQAENII HLFTLTNLGA 1330       1340       1350       1360
PAAFKYFDTT IDRKRYTSTK EVLDATLIHQ SITGLYETRI DLSQLGGD
```

The SpCas9 variants described herein can include mutations at one or more of the following positions: D1135, G1218, R1335, T1337 (or at positions analogous thereto). In some embodiments, the SpCas9 variants include one or more of the following mutations: D1135V; D1135E; G1218R; R1335E; R1335Q; and T1337R. In some embodiments, the SpCas9 variants are at least 80%, e.g., at least 85%, 90%, or 95% identical to the amino acid sequence of SEQ ID NO:1, e.g., have differences at up to 5%, 10%, 15%, or 20% of the residues of SEQ ID NO:1 replaced, e.g., with conservative mutations. In preferred embodiments, the variant retains desired activity of the parent, e.g., the nuclease activity (except where the parent is a nickase or a dead Cas9), and/or the ability to interact with a guide RNA and target DNA).

To determine the percent identity of two nucleic acid sequences, the sequences are aligned for optimal comparison purposes (e.g., gaps can be introduced in one or both of a first and a second amino acid or nucleic acid sequence for optimal alignment and non-homologous sequences can be disregarded for comparison purposes). The length of a reference sequence aligned for comparison purposes is at least 80% of the length of the reference sequence, and in some embodiments is at least 90% or 100%. The nucleotides at corresponding amino acid positions or nucleotide positions are then compared. When a position in the first sequence is occupied by the same nucleotide as the corresponding position in the second sequence, then the molecules are identical at that position (as used herein nucleic acid "identity" is equivalent to nucleic acid "homology"). The percent identity between the two sequences is a function of the number of identical positions shared by the sequences, taking into account the number of gaps, and the length of each gap, which need to be introduced for optimal alignment of the two sequences. Percent identity between two polypeptides or nucleic acid sequences is determined in various ways that are within the skill in the art, for instance, using publicly available computer software such as Smith Waterman Alignment (Smith, T. F. and M. S. Waterman (1981) J Mol Biol 147:195-7); "BestFit" (Smith and Waterman, Advances in Applied Mathematics, 482-489 (1981)) as incorporated into GeneMatcher Plus™, Schwarz and Dayhof (1979) Atlas of Protein Sequence and Structure, Dayhof, M. O., Ed, pp 353-358; BLAST program (Basic Local Alignment Search Tool; (Altschul, S. F., W. Gish, et al. (1990) J Mol Biol 215: 403-10), BLAST-2, BLAST-P, BLAST-N, BLAST-X, WU-BLAST-2, ALIGN, ALIGN-2, CLUSTAL, or Megalign (DNASTAR) software. In addition, those skilled in the art can determine appropriate parameters for measuring alignment, including any algorithms needed to achieve maximal alignment over the length of the sequences being compared. In general, for proteins or nucleic acids, the length of comparison can be any length, up to and including full length (e.g., 5%, 10%, 20%, 30%, 40%, 50%, 60%, 70%, 80%, 90%, 95%, or 100%). For purposes of the present compositions and methods, at least 80% of the full length of the sequence is aligned using the BLAST algorithm and the default parameters.

For purposes of the present invention, the comparison of sequences and determination of percent identity between two sequences can be accomplished using a Blossum 62 scoring matrix with a gap penalty of 12, a gap extend penalty of 4, and a frameshift gap penalty of 5.

Conservative substitutions typically include substitutions within the following groups: glycine, alanine; valine, isoleucine, leucine; aspartic acid, glutamic acid, asparagine, glutamine; serine, threonine; lysine, arginine; and phenylalanine, tyrosine.

In some embodiments, the SpCas9 variants include one of the following sets of mutations: D1135V/R1335Q/T1337R (VQR variant); D1135V/G1218R/R1335Q/T1337R (VRQR variant); D1135E/R1335Q/T1337R (EQR variant); or D1135V/G1218R/R1335E/T1337R (VRER variant).

In some embodiments, the SpCas9 variants also include one of the following mutations, which reduce or destroy the nuclease activity of the Cas9: D10, E762, D839, H983, or D986 and H840 or N863, e.g., D10A/D10N and H840A/H840N/H840Y, to render the nuclease portion of the protein catalytically inactive; substitutions at these positions could be alanine (as they are in Nishimasu al., Cell 156, 935-949 (2014)), or other residues, e.g., glutamine, asparagine, tyrosine, serine, or aspartate, e.g., E762Q, H983N, H983Y, D986N, N863D, N863S, or N863H (see WO 2014/152432). In some embodiments, the variant includes mutations at D10A or H840A (which creates a single-strand nickase), or mutations at D10A and H840A (which abrogates nuclease activity; this mutant is known as dead Cas9 or dCas9).

Also provided herein are SaCas9 variants. The SaCas9 wild type sequence is as follows:

```
                                                        (SEQ ID NO: 2)
                 10         20         30         40         50
         MKRNYILGLD IGITSVGYGI IDYETRDVID AGVRLFKEAN VENNEGRRSK 60         70         80         90        100
         RGARRLKRRR RHRIQRVKKL LFDYNLLTDH SELSGINPYE ARVKGLSQKL 110        120        130        140        150
         SEEEFSAALL HLAKRRGVHN VNEVEEDTGN ELSTKEQISR NSKALEEKYV 160        170        180        190        200
         AELQLERLKK DGEVRGSINR FKTSDYVKEA KQLLKVQKAY HQLDQSFIDT 210        220        230        240        250
         YIDLLETRRT YYEGPGEGSP FGWKDIKEWY EMLMGHCTYF PEELRSVKYA 260        270        280        290        300
         YNADLYNALN DLNNLVITRD ENEKLEYYEK FQIIENVFKQ KKKPTLKQIA 310        320        330        340        350
         KEILVNEEDI KGYRVTSTGK PEFTNLKVYH DIKDITARKE IIENAELLDQ 360        370        380        390        400
         IAKILTIYQS SEDIQEELTN LNSELTQEEI EQISNLKGYT GTHNLSLKAI 410        420        430        440        450
         NLILDELWHT NDNQIAIFNR LKLVPKKVDL SQQKEIPTTL VDDFILSPVV 460        470        480        490        500
         KRSFIQSIKV INAIIKKYGL PNDIIIELAR EKNSKDAQKM INEMQKRNRQ 510        520        530        540        550
         TNERIEEIIR TTGKENAKYL IEKIKLHDMQ EGKCLYSLEA IPLEDLLNNP 560        570        580        590        600
         FNYEVDHIIP RSVSFDNSFN NKVLVKQEEN SKKGNRTPFQ YLSSSDSKIS 610        620        630        640        650
         YETFKKHILN LAKGKGRISK TKKEYLLEER DINRFSVQKD FINRNLVDTR 660        670        680        690        700
         YATRGLMNLL RSYFRVNNLD VKVKSINGGF TSFLRRKWKF KKERNKGYKH 710        720        730        740        750
         HAEDALIIAN ADFIFKEWKK LDKAKKVMEN QMFEEKQAES MPEIETEQEY 760        770        780        790        800
         KEIFITPHQI KHIKDFKDYK YSHRVDKKPN RELINDTLYS TRKDDKGNTL
```

```
         810         820         830         840         850
IVNNLNGLYD  KDNDKLKKLI  NKSPEKLLMY  HHDPQTYQKL  KLIMEQYGDE 860         870         880         890         900
KNPLYKYYEE  TGNYLTKYSK  KDNGPVIKKI  KYYGNKLNAH  LDITDDYPNS 910         920         930         940         950
RNKVVKLSLK  PYRFDVYLDN  GVYKFVTVKN  LDVIKKENYY  EVNSKCYEEA 960         970         980         990        1000
KKLKKISNQA  EFIASFYNND  LIKINGELYR  VIGVNNDLLN  RIEVNMIDIT 1010        1020        1030        1040        1050
YREYLENMND  KRPPRIIKTI  ASKTQSIKKY  STDILGNLYE  VKSKKHPQII

KKG
```

The SaCas9 variants described herein include mutations at one or more of the following positions: E782, N968, and/or R1015 (or at positions analogous thereto). In some embodiments, the variants include one or more of the following mutations: R1015Q, R1015H, E782K, N968K, E735K, K929R, A1021T, K1044N. In some embodiments, the SaCas9 variants include mutations E782K, K929R, N968K, and R1015X, wherein X is any amino acid other than R. In some embodiments, the SaCas9 variants are at least 80%, e.g., at least 85%, 90%, or 95% identical to the amino acid sequence of SEQ ID NO:2, e.g., have differences at up to 5%, 10%, 15%, or 20% of the residues of SEQ ID NO:2 replaced, e.g., with conservative mutations. In preferred embodiments, the variant retains desired activity of the parent, e.g., the nuclease activity (except where the parent is a nickase or a dead Cas9), and/or the ability to interact with a guide RNA and target DNA).

In some embodiments, the SaCas9 variants also include one of the following mutations, which may reduce or destroy the nuclease activity of the SaCas9: D10A, D556A, H557A, N580A, e.g., D10A/H557A and/or D10A/D556A/H557A/N580A, to render the nuclease portion of the protein catalytically inactive; substitutions at these positions could be alanine (as they are in Nishimasu al., Cell 156, 935-949 (2014)), or other residues, e.g., glutamine, asparagine, tyrosine, serine, or aspartate. In some embodiments, the variant includes mutations at D10A, D556A, H557A, or N580A (which may create a single-strand nickase), or mutations at D10A/H557A and/or D10A/D556A/H557A/N580A may (which may abrogate nuclease activity by analogy to SpCas9; these are referred to as dead Cas9 or dCas9).

Also provided herein are isolated nucleic acids encoding the SpCas9 and/or SaCas9 variants, vectors comprising the isolated nucleic acids, optionally operably linked to one or more regulatory domains for expressing the variant proteins, and host cells, e.g., mammalian host cells, comprising the nucleic acids, and optionally expressing the variant proteins.

The variants described herein can be used for altering the genome of a cell; the methods generally include expressing the variant proteins in the cells, along with a guide RNA having a region complementary to a selected portion of the genome of the cell. Methods for selectively altering the genome of a cell are known in the art, see, e.g., U.S. Pat. No. 8,697,359; US2010/0076057; US2011/0189776; US2011/0223638; US2013/0130248; WO/2008/108989; WO/2010/054108; WO/2012/164565; WO/2013/098244; WO/2013/176772; US2015050699; US20150045546; US20150031134; US20150024500; US20140377868; US20140357530; US20140349400; US20140335620; US20140335063; US20140315985; US20140310830; US20140310828; US20140309487; US20140304853; US20140298547; US20140295556; US20140294773; US20140287938; US20140273234; US20140273232; US20140273231; US20140273230; US20140271987; US20140256046; US20140248702; US20140242702; US20140242700; US20140242699; US20140242664; US20140234972; US20140227787; US20140212869; US20140201857; US20140199767; US20140189896; US20140186958; US20140186919; US20140186843; US20140179770; US20140179006; US20140170753; Makarova et al., "Evolution and classification of the CRISPR-Cas systems" 9(6) Nature Reviews Microbiology 467-477 (1-23) (June 2011); Wiedenheft et al., "RNA-guided genetic silencing systems in bacteria and archaea" 482 Nature 331-338 (Feb. 16, 2012); Gasiunas et al., "Cas9-crRNA ribonucleoprotein complex mediates specific DNA cleavage for adaptive immunity in bacteria" 109(39) Proceedings of the National Academy of Sciences USA E2579-E2586 (Sep. 4, 2012); Jinek et al., "A Programmable Dual-RNA-Guided DNA Endonuclease in Adaptive Bacterial Immunity" 337 Science 816-821 (Aug. 17, 2012); Carroll, "A CRISPR Approach to Gene Targeting" 20(9) Molecular Therapy 1658-1660 (September 2012); U.S. Appl. No. 61/652,086, filed May 25, 2012; Al-Attar et al., Clustered Regularly Interspaced Short Palindromic Repeats (CRISPRs): The Hallmark of an Ingenious Antiviral Defense Mechanism in Prokaryotes, Biol Chem. (2011) vol. 392, Issue 4, pp. 277-289; Hale et al., Essential Features and Rational Design of CRISPR RNAs That Function With the Cas RAMP Module Complex to Cleave RNAs, Molecular Cell, (2012) vol. 45, Issue 3, 292-302.

The variant proteins described herein can be used in place of the SpCas9 proteins described in the foregoing references with guide RNAs that target sequences that have PAM sequences according to the following Table 4.

TABLE 4

| Variant protein | Stronger PAM | Weaker PAM |
| --- | --- | --- |
| SpCas9-D1135E | NGG | NAG, NGA, and NNGG |
| SpCas9-VQR | NGAN and NGCG | NGGG, NGTG, and NAAG |
| SpCas9-VRQR | NGAN | |
| SpCas9-EQR | NGAG | NGAT, NGAA, and NGCG |
| SpCas9-VRER | NGCG | NGCA, NGCC, and NGCT |
| SaCas9-KKH | NNNRRT | |

TABLE 4-continued

| Variant protein | Stronger PAM | Weaker PAM |
|---|---|---|
| SaCas9-KKQ | NNRRRT (SEQ ID NO: 45) | NNNRRT |
| SaCas9-KKE | NNCRRT (SEQ ID NO: 47) | NNNRRT |
| SaCas9- (KKL or KKM) | NNTRRT (SEQ ID NO: 48) | NNNRRT |

In addition, the variants described herein can be used in fusion proteins in place of the wild-type Cas9 or other Cas9 mutations (such as the dCas9 or Cas9 nickase described above) as known in the art, e.g., a fusion protein with a heterologous functional domains as described in WO 2014/124284. For example, the variants, preferably comprising one or more nuclease-reducing or killing mutation, can be fused on the N or C terminus of the Cas9 to a transcriptional activation domain or other heterologous functional domains (e.g., transcriptional repressors (e.g., KRAB, ERD, SID, and others, e.g., amino acids 473-530 of the ets2 repressor factor (ERF) repressor domain (ERD), amino acids 1-97 of the KRAB domain of KOX1, or amino acids 1-36 of the Mad mSIN3 interaction domain (SID); see Beerli et al., PNAS USA 95:14628-14633 (1998)) or silencers such as Heterochromatin Protein 1 (HP1, also known as swi6), e.g., HP1α or HP1β; proteins or peptides that could recruit long non-coding RNAs (lncRNAs) fused to a fixed RNA binding sequence such as those bound by the MS2 coat protein, endoribonuclease Csy4, or the lambda N protein; enzymes that modify the methylation state of DNA (e.g., DNA methyltransferase (DNMT) or TET proteins); or enzymes that modify histone subunits (e.g., histone acetyltransferases (HAT), histone deacetylases (HDAC), histone methyltransferases (e.g., for methylation of lysine or arginine residues) or histone demethylases (e.g., for demethylation of lysine or arginine residues)) as are known in the art can also be used. A number of sequences for such domains are known in the art, e.g., a domain that catalyzes hydroxylation of methylated cytosines in DNA. Exemplary proteins include the Ten-Eleven-Translocation (TET)1-3 family, enzymes that converts 5-methylcytosine (5-mC) to 5-hydroxymethylcytosine (5-hmC) in DNA.

Sequences for human TET1-3 are known in the art and are shown in the following table:

| | GenBank Accession Nos. | |
|---|---|---|
| Gene | Amino Acid | Nucleic Acid |
| TET1 | NP_085128.2 | NM_030625.2 |
| TET2* | NP_001120680.1 (var 1) | NM_001127208.2 |
| | NP_060098.3 (var 2) | NM_017628.4 |
| TET3 | NP_659430.1 | NM_144993.1 |

*Variant (1) represents the longer transcript and encodes the longer isoform (a). Variant (2) differs in the 5' UTR and in the 3' UTR and coding sequence compared to variant 1. The resulting isoform (b) is shorter and has a distinct C-terminus compared to isoform a.

In some embodiments, all or part of the full-length sequence of the catalytic domain can be included, e.g., a catalytic module comprising the cysteine-rich extension and the 2OGFeDO domain encoded by 7 highly conserved exons, e.g., the Tet1 catalytic domain comprising amino acids 1580-2052, Tet2 comprising amino acids 1290-1905 and Tet3 comprising amino acids 966-1678. See, e.g., FIG. 1 of Iyer et al., Cell Cycle. 2009 Jun. 1; 8(11):1698-710. Epub 2009 Jun. 27, for an alignment illustrating the key catalytic residues in all three Tet proteins, and the supplementary materials thereof for full length sequences (see, e.g., seq 2c); in some embodiments, the sequence includes amino acids 1418-2136 of Tet1 or the corresponding region in Tet2/3.

Other catalytic modules can be from the proteins identified in Iyer et al., 2009.

In some embodiments, the heterologous functional domain is a biological tether, and comprises all or part of (e.g., DNA binding domain from) the MS2 coat protein, endoribonuclease Csy4, or the lambda N protein. These proteins can be used to recruit RNA molecules containing a specific stem-loop structure to a locale specified by the dCas9 gRNA targeting sequences. For example, a dCas9 variant fused to MS2 coat protein, endoribonuclease Csy4, or lambda N can be used to recruit a long non-coding RNA (lncRNA) such as XIST or HOTAIR; see, e.g., Keryer-Bibens et al., Biol. Cell 100:125-138 (2008), that is linked to the Csy4, MS2 or lambda N binding sequence. Alternatively, the Csy4, MS2 or lambda N protein binding sequence can be linked to another protein, e.g., as described in Keryer-Bibens et al., supra, and the protein can be targeted to the dCas9 variant binding site using the methods and compositions described herein. In some embodiments, the Csy4 is catalytically inactive. In some embodiments, the Cas9 variant, preferably a dCas9 variant, is fused to FokI as described in WO 2014/204578.

In some embodiments, the fusion proteins include a linker between the dCas9 variant and the heterologous functional domains. Linkers that can be used in these fusion proteins (or between fusion proteins in a concatenated structure) can include any sequence that does not interfere with the function of the fusion proteins. In preferred embodiments, the linkers are short, e.g., 2-20 amino acids, and are typically flexible (i.e., comprising amino acids with a high degree of freedom such as glycine, alanine, and serine). In some embodiments, the linker comprises one or more units consisting of GGGS (SEQ ID NO:188) or GGGGS (SEQ ID NO:189), e.g., two, three, four, or more repeats of the GGGS (SEQ ID NO:188) or GGGGS (SEQ ID NO:189) unit. Other linker sequences can also be used.

Expression Systems

To use the Cas9 variants described herein, it may be desirable to express them from a nucleic acid that encodes them. This can be performed in a variety of ways. For example, the nucleic acid encoding the Cas9 variant can be cloned into an intermediate vector for transformation into prokaryotic or eukaryotic cells for replication and/or expression. Intermediate vectors are typically prokaryote vectors, e.g., plasmids, or shuttle vectors, or insect vectors, for storage or manipulation of the nucleic acid encoding the Cas9 variant for production of the Cas9 variant. The nucleic acid encoding the Cas9 variant can also be cloned into an expression vector, for administration to a plant cell, animal cell, preferably a mammalian cell or a human cell, fungal cell, bacterial cell, or protozoan cell.

To obtain expression, a sequence encoding a Cas9 variant is typically subcloned into an expression vector that contains a promoter to direct transcription. Suitable bacterial and eukaryotic promoters are well known in the art and described, e.g., in Sambrook et al., Molecular Cloning, A Laboratory Manual (3d ed. 2001); Kriegler, Gene Transfer and Expression: A Laboratory Manual (1990); and Current Protocols in Molecular Biology (Ausubel et al., eds., 2010). Bacterial expression systems for expressing the engineered protein are available in, e.g., *E. coli, Bacillus* sp., and

*Salmonella* (Palva et al., 1983, Gene 22:229-235). Kits for such expression systems are commercially available. Eukaryotic expression systems for mammalian cells, yeast, and insect cells are well known in the art and are also commercially available.

The promoter used to direct expression of a nucleic acid depends on the particular application. For example, a strong constitutive promoter is typically used for expression and purification of fusion proteins. In contrast, when the Cas9 variant is to be administered in vivo for gene regulation, either a constitutive or an inducible promoter can be used, depending on the particular use of the Cas9 variant. In addition, a preferred promoter for administration of the Cas9 variant can be a weak promoter, such as HSV TK or a promoter having similar activity. The promoter can also include elements that are responsive to transactivation, e.g., hypoxia response elements, Gal4 response elements, lac repressor response element, and small molecule control systems such as tetracycline-regulated systems and the RU-486 system (see, e.g., Gossen & Bujard, 1992, Proc. Natl. Acad. Sci. USA, 89:5547; Oligino et al., 1998, Gene Ther., 5:491-496; Wang et al., 1997, Gene Ther., 4:432-441; Neering et al., 1996, Blood, 88:1147-55; and Rendahl et al., 1998, Nat. Biotechnol., 16:757-761).

In addition to the promoter, the expression vector typically contains a transcription unit or expression cassette that contains all the additional elements required for the expression of the nucleic acid in host cells, either prokaryotic or eukaryotic. A typical expression cassette thus contains a promoter operably linked, e.g., to the nucleic acid sequence encoding the Cas9 variant, and any signals required, e.g., for efficient polyadenylation of the transcript, transcriptional termination, ribosome binding sites, or translation termination. Additional elements of the cassette may include, e.g., enhancers, and heterologous spliced intronic signals.

The particular expression vector used to transport the genetic information into the cell is selected with regard to the intended use of the Cas9 variant, e.g., expression in plants, animals, bacteria, fungus, protozoa, etc. Standard bacterial expression vectors include plasmids such as pBR322 based plasmids, pSKF, pET23D, and commercially available tag-fusion expression systems such as GST and LacZ.

Expression vectors containing regulatory elements from eukaryotic viruses are often used in eukaryotic expression vectors, e.g., SV40 vectors, papilloma virus vectors, and vectors derived from Epstein-Barr virus. Other exemplary eukaryotic vectors include pMSG, pAV009/A+, pMTO10/A+, pMAMneo-5, baculovirus pDSVE, and any other vector allowing expression of proteins under the direction of the SV40 early promoter, SV40 late promoter, metallothionein promoter, murine mammary tumor virus promoter, Rous sarcoma virus promoter, polyhedrin promoter, or other promoters shown effective for expression in eukaryotic cells.

The vectors for expressing the Cas9 variants can include RNA Pol III promoters to drive expression of the guide RNAs, e.g., the H1, U6 or 7SK promoters. These human promoters allow for expression of Cas9 variants in mammalian cells following plasmid transfection.

Some expression systems have markers for selection of stably transfected cell lines such as thymidine kinase, hygromycin B phosphotransferase, and dihydrofolate reductase. High yield expression systems are also suitable, such as using a baculovirus vector in insect cells, with the gRNA encoding sequence under the direction of the polyhedrin promoter or other strong baculovirus promoters.

The elements that are typically included in expression vectors also include a replicon that functions in *E. coli*, a gene encoding antibiotic resistance to permit selection of bacteria that harbor recombinant plasmids, and unique restriction sites in nonessential regions of the plasmid to allow insertion of recombinant sequences.

Standard transfection methods are used to produce bacterial, mammalian, yeast or insect cell lines that express large quantities of protein, which are then purified using standard techniques (see, e.g., Colley et al., 1989, J. Biol. Chem., 264:17619-22; Guide to Protein Purification, in Methods in Enzymology, vol. 182 (Deutscher, ed., 1990)). Transformation of eukaryotic and prokaryotic cells are performed according to standard techniques (see, e.g., Morrison, 1977, J. Bacteriol. 132:349-351; Clark-Curtiss & Curtiss, Methods in Enzymology 101:347-362 (Wu et al., eds, 1983).

Any of the known procedures for introducing foreign nucleotide sequences into host cells may be used. These include the use of calcium phosphate transfection, polybrene, protoplast fusion, electroporation, nucleofection, liposomes, microinjection, naked DNA, plasmid vectors, viral vectors, both episomal and integrative, and any of the other well-known methods for introducing cloned genomic DNA, cDNA, synthetic DNA or other foreign genetic material into a host cell (see, e.g., Sambrook et al., supra). It is only necessary that the particular genetic engineering procedure used be capable of successfully introducing at least one gene into the host cell capable of expressing the Cas9 variant.

The present invention includes the vectors and cells comprising the vectors.

EXAMPLES

The invention is further described in the following examples, which do not limit the scope of the invention described in the claims.

Methods

The following materials and methods were used in Examples 1 and 2.

Plasmids and Oligonucleotides

Schematic maps and DNA sequences for parent constructs used in this study can be found in FIGS. 5A-J and SEQ ID NOs:7-20. Sequences of oligonucleotides used to generate the positive selection plasmids, negative selection plasmids, and site-depletion libraries are available in Table 1. Sequences of all gRNA targets in this study are available in Table 2. Point mutations in Cas9 were generated by PCR.

TABLE 1

| sequence | description | SEQ ID NO: |
|---|---|---|
| Oligos used to generate positive and negative selection plasmids | | |
| ctagaGGGCACGGGCAGCTTGCCGGTGGgcatg | top oligo to clone site 1 into the positive selection vector (XbaI/SphI cut p11-lacY-wtx1) | 190 |

TABLE 1-continued

| sequence | description | SEQ ID NO: |
|---|---|---|
| cCCACCGGCAAGCTGCCCGTGCCCt | bottom oligo to clone site 1 into the positive selection vector | 191 |
| ctagaGGTCGCCCTCGAACTTCACCTCGGgcatg | top oligo to clone site 2 into the positive selection vector (XbaI/SphI cut p11-lacY-wtx1) | 192 |
| cCCGAGGTGAAGTTCGAGGGCGACCt | bottom oligo to clone site 2 into the positive selection vector | 193 |
| aattcGGGCACGGGCAGCTTGCCGGTGGgcatg | top oligo to clone site 1 into the negative selection vector (EcoRI/SphI cut p11-lacY-wtx1) | 194 |
| cCCACCGGCAAGCTGCCCGTGCCCg | bottom oligo to clone site 1 into the negative selection vector | 195 |
| aattcGGTCGCCCTCGAACTTCACCTCGGgcatg | top oligo to clone site 2 into the negative selection vector (EcoRI/SphI cut p11-lacY-wtx1) | 196 |
| cCCGAGGTGAAGTTCGAGGGCGACCg | bottom oligo to clone site 2 into the negative selection vector | 197 |

Oligos used to generate libraries for site-depletion experiments

| sequence | description | |
|---|---|---|
| GCAGgaattcGGGCACGGGCAGCTTGCCGGNNNNNNCTNNNGCGCAGGTCACGAGGCATG | top strand oligo for site 1 PAM library, cut with EcoRI once filled in | 198 |
| GCAGgaattcGTCGCCCTCGAACTTCACCTNNNNNNCTNNNGCGCAGGTCACGAGGCATG | top strand oligo for site 2 PAM library, cut with EcoRI once filled in | 199 |
| /5Phos/ccTcGTGAccTGcGc | reverse primer to fill in library oligos | 200 |

Primers used to amplify site-depletion libraries for sequencing

| sequence | description | |
|---|---|---|
| GATACCGCTCGCCGCAGC | forward primer | 201 |
| CTGCGTTCTGATTTAATCTGTATCAGGC | reverse primer | 202 |

Primers used for T7E1 experiments

| sequence | description | |
|---|---|---|
| GGAGATGTAAATCACCTCCATCTGA | forward primer targeted to th1 in zebrafish | 203 |
| ATGTTAGCCTACCTCGAAAACCTTC | reverse primer targeted to th1 in zebrafish | 204 |
| CCTGTGCTCTCCTGTTTTTAGGTAT | forward primer targeted to tia1L in zebrafish | 205 |
| AACATGGTAAGAAGCGTGAGTGTTT | reverse primer targeted to tia1L in zebrafish | 206 |
| CAGGCTGTTGAACCGTAGATTTAGT | forward primer targeted to fh in zebrafish | 207 |
| TCCACATGTTTTGAGTTTGAGAGTC | reverse primer targeted to fh in zebrafish | 208 |
| GGAGCAGCTGGTCAGAGGGG | forward primer targeted to EMX1 in U2OS human cells | 209 |
| CCATAGGGAAGGGGGACACTGG | reverse primer targeted to EMX1 in U2OS human cells | 210 |
| GGGCCGGGAAAGAGTTGCTG | forward primer targeted to FANCF in U2OS human cells | 211 |
| GCCCTACATCTGCTCTCCCTCC | reverse primer targeted to FANCF in U2OS human cells | 212 |
| CCAGCACAACTTACTCGCACTTGAC | forward primer targeted to RUNX1 in U2OS human cells | 213 |
| CATCACCAACCCACAGCCAAGG | reverse primer targeted to RUNX1 in U2OS human cells | 214 |
| GATGAGGGCTCCAGATGGCAC | forward primer targeted to VEGFA in U2OS human cells | 215 |
| GAGGAGGGAGCAGGAAAGTGAGG | reverse primer targeted to VEGFA in U2OS human cells | 216 |

TABLE 2

S. pyogenes gRNAs
EGFP
NXX gRNAs

| Prep Name | Name | Spacer length (nt) | Sequence | SEQ ID NO: | Sequence with extended PAM | SEQ ID NO: |
|---|---|---|---|---|---|---|
| FYF1320 | NGG 1-20 | 20 | GGGCACGGGCAGCTTGCCGG | 217 | GGGCACGGGCAGCTTGCCGGTGGT | 218 |
| BPK1345 | NGG 2-20 | 20 | GTCGCCCTCGAACTTCACCT | 219 | GTCGCCCTCGAACTTCACCTCGGC | 220 |
| MSP792 | NGG 3-20 | 20 | GGTCGCCACCATGGTGAGCA | 221 | GGTCGCCACCATGGTGAGCAAGGG | 222 |
| MSP795 | NGG 4-20 | 20 | GGTCAGGGTGGTCACGAGGG | 223 | GGTCAGGGTGGTCACGAGGGTGGG | 224 |

TABLE 2-continued

| Prep Name | Name | Spacer length (nt) | Sequence | SEQ ID NO: | Sequence with extended PAM | SEQ ID NO: |
|---|---|---|---|---|---|---|
| FYF1328 | NGG 5-20 | 20 | GGTGGTGCAGATGAACTTCA | 225 | GGTGGTGCAGATGAACTTCAGGGT | 226 |
| MSP160 | NAG 1-20 | 20 | GGGTGGTGCCCATCCTGGTC | 227 | GGGTGGTGCCCATCCTGGTCGAGC | 228 |
| MSP161 | NAG 2-20 | 20 | GACGTAAACGGCCACAAGTT | 229 | GACGTAAACGGCCACAAGTTCAGC | 230 |
| MSP162 | NAG 3-20 | 20 | GTGCAGATGAACTTCAGGGT | 231 | GTGCAGATGAACTTCAGGGTCAGC | 232 |
| MSP163 | NAG 4-20 | 20 | GGGTGGTCACGAGGGTGGGC | 233 | GGGTGGTCACGAGGGTGGGCCAGG | 234 |
| MSP164 | NAA 1-20 | 20 | GGTCGAGCTGGACGGCGACG | 235 | GGTCGAGCTGGACGGCGACGTAAA | 236 |
| MSP165 | NAA 2-20 | 20 | GTCGAGCTGGACGGCGACGT | 237 | GTCGAGCTGGACGGCGACGTAAAC | 238 |
| MSP168 | NGA 1-20 | 20 | GGGGTGGTGCCCATCCTGGT | 239 | GGGGTGGTGCCCATCCTGGTCGAG | 240 |
| MSP366 | NGA 2-20 | 20 | GCCACCATGGTGAGCAAGGG | 241 | GCCACCATGGTGAGCAAGGGCGAG | 242 |
| MSP171 | NGA 3-20 | 20 | GTCGCCGTCCAGCTCGACCA | 243 | GTCGCCGTCCAGCTCGACCAGGAT | 244 |
| BPK1466 | NGA 4-20 | 20 | GCATCGCCCTCGCCCTCGCC | 245 | GCATCGCCCTCGCCCTCGCCGGAC | 246 |
| BPK1468 | NGA 5-20 | 20 | GTTCGAGGGCGACACCCTGG | 247 | GTTCGAGGGCGACACCCTGGTGAA | 248 |

NGXX gRNAs

| Prep Name | Name | Spacer length (nt) | Sequence | SEQ ID NO: | Sequence with extended PAM | SEQ ID NO: |
|---|---|---|---|---|---|---|
| BPK1468 | NGAA 1-20 | 20 | GTTCGAGGGCGACACCCTGG | 249. | GTTCGAGGGCGACACCCTGGTGAA | 250. |
| MSP807 | NGAA 2-20 | 20 | GTTCACCAGGGTGTCGCCCT | 251. | GTTCACCAGGGTGTCGCCCTCGAA | 252. |
| BPK1469 | NGAA 3-20 | 20 | GCAGAAGAACGGCATCAAGG | 253. | GCAGAAGAACGGCATCAAGGTGAA | 254. |
| MSP787 | NGAA 3-17 | 17 | GAAGAACGGCATCAAGG | 255. | GAAGAACGGCATCAAGGTGAA | 256. |
| MSP170 | NGAC 1-20 | 20 | GCCCACCCTCGTGACCACCC | 257. | GCCCACCCTCGTGACCACCCTGAC | 258. |
| MSP790 | NGAC 2-20 | 20 | GCCCTTGCTCACCATGGTGG | 259. | GCCCTTGCTCACCATGGTGGCGAC | 260. |
| MSP171 | NGAT 1-20 | 20 | GTCGCCGTCCAGCTCGACCA | 261. | GTCGCCGTCCAGCTCGACCAGGAT | 262. |
| BPK1979 | NGAT 1-17 | 17 | GCCGTCCAGCTCGACCA | 263. | GCCGTCCAGCTCGACCAGGAT | 264. |
| MSP169 | NGAT 2-20 | 20 | GTGTCCGGCGAGGGCGAGGG | 265. | GTGTCCGGCGAGGGCGAGGGCGAT | 266. |
| BPK1464 | NGAT 3-20 | 20 | GGGCAGCTTGCCGGTGGTGC | 267. | GGGCAGCTTGCCGGTGGTGCAGAT | 268. |
| MSP788 | NGAT 3-19 | 19 | GGCAGCTTGCCGGTGGTGC | 269. | GGCAGCTTGCCGGTGGTGCAGAT | 270. |
| MSP789 | NGAT 3-18 | 18 | GCAGCTTGCCGGTGGTGC | 271. | GCAGCTTGCCGGTGGTGCAGAT | 272. |
| MSP168 | NGAG 1-20 | 20 | GGGGTGGTGCCCATCCTGGT | 273. | GGGGTGGTGCCCATCCTGGTCGAG | 274. |
| MSP783 | NGAG 1-19 | 19 | GGGTGGTGCCCATCCTGGT | 275. | GGGTGGTGCCCATCCTGGTCGAG | 276. |
| MSP784 | NGAG 1-18 | 18 | GGTGGTGCCCATCCTGGT | 277. | GGTGGTGCCCATCCTGGTCGAG | 278. |
| MSP785 | NGAG 1-17 | 17 | GTGGTGCCCATCCTGGT | 279. | GTGGTGCCCATCCTGGTCGAG | 280. |
| MSP366 | NGAG 2-20 | 20 | GCCACCATGGTGAGCAAGGG | 281. | GCCACCATGGTGAGCAAGGGCGAG | 282. |
| MSP368 | NGAG 3-20 | 20 | GCCGTAGGTCAGGGTGGTCA | 283. | GCCGTAGGTCAGGGTGGTCACGAG | 284. |
| BPK1974 | NGAG 3-17 | 17 | GTAGGTCAGGGTGGTCA | 285. | GTAGGTCAGGGTGGTCACGAG | 286. |
| MSP376 | NGAG 4-20 | 20 | GCTGCCCGACAACCACTACC | 287. | GCTGCCCGACAACCACTACCTGAG | 288. |
| BPK1978 | NGAG 4-17 | 17 | GCCCGACAACCACTACC | 289. | GCCCGACAACCACTACCTGAG | 290. |
| MSP1028 | NGCA 1-20 | 20 | GCGAGGGCGATGCCACCTAC | 291. | GCGAGGGCGATGCCACCTACGCA | 292. |
| MSP1030 | NGCA 2-20 | 20 | GTGGTCGGGGTAGCGGTGA | 293. | GTGGTCGGGGTAGCGGTGAAGCA | 294. |
| MSP1032 | NGCC 1-20 | 20 | GGAGCTGTTCACCGGGGTGG | 295. | GGAGCTGTTCACCGGGGTGGTGCC | 296. |
| MSP1033 | NGCC 2-20 | 20 | GAACTTGTGGCCGTTTACGT | 297. | GAACTTGTGGCCGTTTACGTCGCC | 298. |
| MSP1036 | NGCT 1-20 | 20 | GGTGAACAGCTCCTCGCCCT | 299. | GGTGAACAGCTCCTCGCCCTTGCT | 300. |
| MSP1037 | NGCT 2-20 | 20 | GGTGGTGCCCATCCTGGTCG | 301. | GGTGGTGCCCATCCTGGTCGAGCT | 302. |
| MSP800 | NGCG 1-20 | 20 | GCCACAAGTTCAGCGTGTCC | 303. | GCCACAAGTTCAGCGTGTCCGGCG | 304. |
| MSP801 | NGCG 2-20 | 20 | GCGTGTCCGGCGAGGGCGAG | 305. | GCGTGTCCGGCGAGGGCGAGGGCG | 306. |
| MSP1360 | NGCG 2-18 | 18 | GTGTCCGGCGAGGGCGAG | 307. | GTGTCCGGCGAGGGCGAGGGCG | 308. |
| MSP802 | NGCG 3-20 | 20 | GCCCGAAGGCTACGTCCAGG | 309. | GCCCGAAGGCTACGTCCAGGAGCG | 310. |
| MSP803 | NGCG 4-20 | 20 | GTCGTCCTTGAAGAAGATGG | 311. | GTCGTCCTTGAAGAAGATGGTGCG | 312. |
| MSP1366 | NGCG 4-17 | 17 | GTCCTTGAAGAAGATGG | 313. | GTCCTTGAAGAAGATGGTGCG | 314. |
| MSP792 | NGGG 1-20 | 20 | GGTCGCCACCATGGTGAGCA | 315. | GGTCGCCACCATGGTGAGCAAGGG | 316. |
| MSP794 | NGGG 2-20 | 20 | GGTGGTCACGAGGGTGGGCC | 317. | GGTGGTCACGAGGGTGGGCCAGGG | 318. |
| MSP796 | NGTG 1-20 | 20 | GATCCACCGGTCGCCACCAT | 319. | GATCCACCGGTCGCCACCATGGTG | 320. |
| MSP799 | NGTG 2-20 | 20 | GTAAACGGCCACAAGTTCAG | 321. | GTAAACGGCCACAAGTTCAGCGTG | 322. |

Endogenous genes
EMX1

| Prep Name | Name | Spacer length (nt) | Sequence | SEQ ID NO: | Sequence with extended PAM | SEQ ID NO: |
|---|---|---|---|---|---|---|
| FYF1548 | NGG 1-20 | 20 | GAGTCCGAGCAGAAGAAGAA | 323. | GAGTCCGAGCAGAAGAAGAAGGGC | 324. |
| MSP809 | NGG 2-20 | 20 | GTCACCTCCAATGACTAGGG | 325. | GTCACCTCCAATGACTAGGGTGGG | 326. |
| MSP811 | NGA 1-20 | 20 | GAGGAGGAAGGGCCTGAGTC | 327. | GAGGAGGAAGGGCCTGAGTCCAGA | 328. |
| MSP812 | NGA 2-20 | 20 | GGTTGCCCACCCTAGTCATT | 329. | GGTTGCCCACCCTAGTCATTGGAG | 330. |
| MSP813 | NGA 3-20 | 20 | GCTGAGCTGAGAGCCTGATG | 331. | GCTGAGCTGAGAGCCTGATGGGAA | 332. |
| MSP814 | NGA 4-20 | 20 | GCCACGAAGCAGGCCAATGG | 333. | GCCACGAAGCAGGCCAATGGGGAG | 334. |

FANCF

| Prep Name | Name | Spacer length (nt) | Sequence | SEQ ID NO: | Sequence with extended PAM | SEQ ID NO: |
|---|---|---|---|---|---|---|
| DR348 | NGG 1-20 | 20 | GGAATCCCTTCTGCAGCACC | 335. | GGAATCCCTTCTGCAGCACCTGGA | 336. |
| MSP815 | NGG 2-20 | 20 | GCTGCAGAAGGGATTCCATG | 337. | GCTGCAGAAGGGATTCCATGAGGT | 338. |
| MSP818 | NGA 1-20 | 20 | GAATCCCTTCTGCAGCACCT | 339. | GAATCCCTTCTGCAGCACCTGGAT | 340. |

TABLE 2-continued

| Prep Name | Name | Spacer length (nt) | Sequence | SEQ ID NO: | Sequence with extended PAM | SEQ ID NO: |
|---|---|---|---|---|---|---|
| MSP819 | NGA 2-20 | 20 | GTGCTGCAGAAGGGATTCCA | 341. | GTGCTGCAGAAGGGATTCCATGAG | 342. |
| MSP820 | NGA 3-20 | 20 | GCGGCGGCTGCACAACCAGT | 343. | GCGGCGGCTGCACAACCAGTGGAG | 344. |
| MSP885 | NGA 4-20 | 20 | GGTTGTGCAGCCGCCGCTCC | 345. | GGTTGTGCAGCCGCCGCTCCAGAG | 346. |
| MSP1060 | NGCG 1-20 | 20 | GAGGCAAGAGGGCGGCTTTG | 347. | GAGGCAAGAGGGCGGCTTTGGGCG | 348. |
| MSP1061 | NGCG 2-19 | 19 | GGGGTCCAGTTCCGGGATT | 349. | GGGGTCCAGTTCCGGGATTAGCG | 350. |
| MSP1062 | NGCG 3-20 | 20 | GCAGAAGGGATTCCATGAGG | 351. | GCAGAAGGGATTCCATGAGGTGCG | 352. |
| MSP1063 | NGCG 4-19 | 19 | GAAGGGATTCCATGAGGTG | 353. | GAAGGGATTCCATGAGGTGCGCG | 354. |

RUNX1

| Prep Name | Name | Spacer length (nt) | Sequence | SEQ ID NO: | Sequence with extended PAM | SEQ ID NO: |
|---|---|---|---|---|---|---|
| MSP823 | NGG 1-20 | 20 | GCTGAAACAGTGACCTGTCT | 355. | GCTGAAACAGTGACCTGTCTTGGT | 356. |
| MSP824 | NGG 2-20 | 20 | GATGTAGGGCTAGAGGGGTG | 357. | GATGTAGGGCTAGAGGGGTGAGGC | 358. |
| MSP826 | NGA 1-20 | 20 | GGTGCATTTTCAGGAGGAAG | 359. | GGTGCATTTTCAGGAGGAAGCGAT | 360. |
| MSP827 | NGA 2-20 | 20 | GTTTTCGCTCCGAAGGTAAA | 361. | GTTTTCGCTCCGAAGGTAAAAGAA | 362. |
| MSP828 | NGA 3-20 | 20 | GAGATGTAGGGCTAGAGGGG | 363. | GAGATGTAGGGCTAGAGGGGTGAG | 364. |
| MSP829 | NGA 4-20 | 20 | GCAGAGGGGAGAAGAAAGAG | 365. | GCAGAGGGGAGAAGAAAGAGAGAT | 366. |
| MSP1068 | NGCG 1-19 | 19 | GGGTGCATTTTCAGGAGGA | 367. | GGGTGCATTTTCAGGAGGAAGCG | 368. |

VEGFA

| Prep Name | Name | Spacer length (nt) | Sequence | SEQ ID NO: | Sequence with extended PAM | SEQ ID NO: |
|---|---|---|---|---|---|---|
| VC228 | NGG 1-20 | 20 | GGTGAGTGAGTGTGTGCGTG | 369. | GGTGAGTGAGTGTGTGCGTGTGGG | 370. |
| MSP830 | NGG 2-20 | 20 | GTTGGAGCGGGGAGAAGGCC | 371. | GTTGGAGCGGGGAGAAGGCCAGGG | 372. |
| BPK1846 | NGA 1-20 | 20 | GCGAGCAGCGTCTTCGAGAG | 373. | GCGAGCAGCGTCTTCGAGAGTGAG | 374. |
| BPK1848 | NGA 2-20 | 20 | GACGTGTGTGTCTGTGTGGG | 375. | GACGTGTGTGTCTGTGTGGGTGAG | 376. |
| BPK1850 | NGA 3-20 | 20 | GGTTGAGGGCGTTGGAGCGG | 377. | GGTTGAGGGCGTTGGAGCGGGGAG | 378. |
| MSP831 | NGA 4-20 | 20 | GCTTTGGAAAGGGGTGGGG | 379. | GCTTTGGAAAGGGGTGGGGGAG | 380. |
| MSP1074 | NGCG 1-20 | 20 | GCAGACGGCAGTCACTAGGG | 381. | GCAGACGGCAGTCACTAGGGGGCG | 382. |
| MSP1075 | NGCG 2-20 | 20 | GCTGGGTGAATGGAGCGAGC | 383. | GCTGGGTGAATGGAGCGAGCAGCG | 384. |
| MSP1076 | NGCG 3-19 | 19 | GTGTGGGTGAGTGAGTGTG | 385. | GTGTGGGTGAGTGAGTGTGTGCG | 386. |
| MSP1077 | NGCG 4-19 | 19 | GTGTGCGTGTGGGGTTGAG | 387. | GTGTGCGTGTGGGGTTGAGGGCG | 388. |

S. aureus gRNAs
EGFP

| Prep Name | Name | Spacer length (nt) | Sequence | SEQ ID NO: | Sequence with extended PAM | SEQ ID NO: |
|---|---|---|---|---|---|---|
| MSP1395 | Site 1-20 | 20 | GTCGTGCTGCTTCATGTGGT | 389. | GTCGTGCTGCTTCATGTGGTCGGGGT | 390. |
| MSP1405 | Site 1-23 | 23 | GAAGTCGTGCTGCTTCATGTGGT | 391. | GAAGTCGTGCTGCTTCATGTGGTCGGGGT | 392. |
| MSP1396 | Site 2-21 | 21 | GCCGGTGGTGCAGATGAACTT | 393. | GCCGGTGGTGCAGATGAACTTCAGGGT | 394. |
| MSP1397 | Site 3-21 | 21 | GCCGTAGGTCAGGGTGGTCAC | 395. | GCCGTAGGTCAGGGTGGTCACGAGGGT | 396. |
| MSP1400 | Site 4-21 | 21 | GCAACATCCTGGGGCACAAGC | 397. | GCAACATCCTGGGGCACAAGCTGGAGT | 398. |
| MSP1404 | Site 4-22 | 22 | GGCAACATCCTGGGGCACAAGC | 399. | GGCAACATCCTGGGGCACAAGCTGGAGT | 400. |
| MSP1398 | Site 5-21 | 21 | GAAGCACTGCACGCCGTAGGT | 401. | GAAGCACTGCACGCCGTAGGTCAGGGT | 402. |
| MSP1408 | Site 5-24 | 24 | GCTGAAGCACTGCACGCCGTAGGT | 403. | GCTGAAGCACTGCACGCCGTAGGTCAGGGT | 404. |
| MSP1428 | Site 6-21 | 21 | GCCCTCGAACTTCACCTCGGC | 405. | GCCCTCGAACTTCACCTCGGCGCGGGT | 406. |
| MSP1409 | Site 6-24 | 24 | GTCGCCCTCGAACTTCACCTCGGC | 407. | GTCGCCCTCGAACTTCACCTCGGCGCGGGT | 408. |
| MSP1403 | Site 7-22 | 22 | GCAAGGGCGAGGAGCTGTTCAC | 409. | GCAAGGGCGAGGAGCTGTTCACCGGGGT | 410. |
| MSP1406 | Site 7-24 | 24 | GAGCAAGGGCGAGGAGCTGTTCAC | 411. | GAGCAAGGGCGAGGAGCTGTTCACCGGGGT | 412. |
| MSP1410 | Site 8-24 | 24 | GCCCTTCAGCTCGATGCGGTTCAC | 413. | GCCCTTCAGCTCGATGCGGTTCACCAGGGT | 414. |

S. thermophilus1 gRNAs
EGFP

| Prep Name | Name | Spacer length (nt) | Sequence | SEQ ID NO: | Sequence with extended PAM | SEQ ID NO: |
|---|---|---|---|---|---|---|
| MSP1412 | Site 1-20 | 20 | GTCTATATCATGGCCGACAA | 415. | GTCTATATCATGGCCGACAAGCAGAA | 416. |
| MSP1414 | Site 2-21 | 21 | GCAGCTCGCCGACCACTACCA | 417. | GCAGCTCGCCGACCACTACCAGCAGAA | 418. |
| MSP1417 | Site 2-23 | 23 | GTGCAGCTCGCCGACCACTACCA | 419. | GTGCAGCTCGCCGACCACTACCAGCAGAA | 420. |
| MSP1413 | Site 3-21 | 21 | GCCTTCGGGCATGGCGGACTT | 421. | GCCTTCGGGCATGGCGGACTTGAAGAA | 422. |
| MSP1418 | Site 3-24 | 24 | GTAGCCTTCGGGCATGGCGGACTT | 423. | GTAGCCTTCGGGCATGGCGGACTTGAAGAA | 424. |
| MSP1416 | Site 4-23 | 23 | GTCTATATCATGGCCGACAAGCA | 425. | GTCTATATCATGGCCGACAAGCAGAAGAA | 426. |
| MSP1415 | Site 5-23 | 23 | GCTTGTAGTTGCCGTCGTCCTT | 427. | GCTTGTAGTTGCCGTCGTCCTTGAAGAA | 428. |
| MSP1419 | Site 5-24 | 24 | GGTCTTGTAGTTGCCGTCGTCCTT | 429. | GGTCTTGTAGTTGCCGTCGTCCTTGAAGAA | 430. |

Bacterial Cas9/sgRNA expression plasmids were constructed with two T7 promoters to separately express Cas9 and the sgRNA. These plasmids encode human codon optimized versions of Cas9 for S. pyogenes (BPK764, SpCas9 sequence subcloned from JDS246[17]), S. thermophilus Cas9 from CRISPR locus 1 (MSP1673, St1Cas9 sequence modified from previous published description[20]), and S. aureus (BPK2101, SaCas9 sequence codon optimized from Uniprot J7RUA5). Previously described sgRNA sequences were utilized for SpCas9[34, 35] and St1Cas9[20], while the SaCas9 sgRNA sequence was determined by searching the European Nucleotide Archive sequence HE980450 for crRNA repeats using CRISPRfinder and identifying the tracrRNA using a bioinformatic approach similar to one previously described[36]. Annealed oligos to complete the spacer complementarity region of the sgRNA were ligated into BsaI cut BPK764 and BPK2101, or BspMI cut MSP1673 (append 5'-ATAG to the spacer to generate the top oligo and append 5'-AAAC to the reverse compliment of the spacer sequence to generate the bottom oligo).

Residues 1097-1368 of SpCas9 were randomly mutagenized using Mutazyme II (Agilent Technologies) at a rate of ~5.2 substitutions/kilobase to generate mutagenized PAM-interacting (PI) domain libraries. The theoretical complexity of each PI domain library was estimated to be greater than $10^7$ clones based on the number of transformants obtained. Positive and negative selection plasmids were generated by ligating annealed target site oligos into XbarSphI or EcoRI/SphI cut p11-lacY-wtx1[17], respectively.

Two randomized PAM libraries (each with a different protospacer sequence) were constructed using Klenow(-exo) to fill-in the bottom strand of oligos that contained six randomized nucleotides directly adjacent to the 3' end of the protospacer (see Table 1). The double-stranded product was cut with EcoRI to leave EcoRI/SphI ends for ligation into cut p11-lacY-wtx1. The theoretical complexity of each randomized PAM library was estimated to be greater than $10^6$ based on the number of transformants obtained.

SpCas9 and SpCas9 variants were expressed in human cells from vectors derived from JDS246[16]. For St1Cas9 and SaCas9, the Cas9 ORFs from MSP1673 and BPK2101 were subcloned into a CAG promoter vector to generate MSP1594 and BPK2139, respectively. Plasmids for U6 expression of sgRNAs (into which desired spacer oligos can be cloned) were generated using the sgRNA sequences described above for the SpCas9 sgRNA (BPK1520), the St1Cas9 sgRNA (BPK2301), and the SaCas9 gRNA (VVT1). Annealed oligos to complete the spacer complementarity region of the sgRNA were ligated into the BsmBI overhangs of these vectors (append 5'-CACC to the spacer to generate the top oligo and append 5'-AAAC to the reverse complement of the spacer sequence to generate the bottom oligo).

Bacterial-based positive selection assay for evolving SpCas9 variants Competent E. coli BW25141($\lambda$DE3)[23] containing a positive selection plasmid (with embedded target site) were transformed with Cas9/sgRNA-encoding plasmids. Following a 60 minute recovery in SOB media, transformations were plated on LB plates containing either chloramphenicol (non-selective) or chloramphenicol+10 mM arabinose (selective). Cleavage of the positive selection plasmid was estimated by calculating the survival frequency: colonies on selective plates/colonies on non-selective plates (see also FIG. 12).

To select for SpCas9 variants that can cleave novel PAMs, PI-domain mutagenized Cas9/sgRNA plasmid libraries were electroporated into E. coli BW25141($\lambda$DE3) cells containing a positive selection plasmid that encodes a target site+PAM of interest. Generally 50,000 clones were screened to obtain between 50-100 survivors. The PI domains of surviving clones were subcloned into fresh backbone plasmid and re-tested in the positive selection. Clones that had greater than 10% survival in this secondary screen for activity were sequenced. Mutations observed in the sequenced clones were chosen for further assessment based on their frequency in surviving clones, type of substitution, proximity to the PAM bases in the SpCas9/sgRNA crystal structure (PDB:4UN3)[14], and (in some cases) activities in a human cell-based EGFP disruption assay.

Bacterial-Based Site-Depletion Assay for Profiling Cas9 PAM Specificities

Competent E. coli BW25141($\lambda$DE3) containing a Cas9/sgRNA expression plasmid were transformed with negative selection plasmids harboring cleavable or non-cleavable target sites. Following a 60 minute recovery in SOB media, transformations were plated on LB plates containing chloramphenicol+carbenicillin. Cleavage of the negative selection plasmid was estimated by calculating the colony forming units per μg of DNA transformed (see also FIG. 13).

The negative selection was adapted to determine PAM specificity profiles of Cas9 nucleases by electroporating each randomized PAM library into E. coli BW25141($\lambda$DE3) cells that already harbored an appropriate Cas9/sgRNA plasmid. Between 80,000-100,000 colonies were plated at a low density spread on LB+chloramphenicol+carbenicillin plates. Surviving colonies containing negative selection plasmids refractory to cleavage by Cas9 were harvested and plasmid DNA isolated by maxi-prep (Qiagen). The resulting plasmid library was amplified by PCR using Phusion Hotstart Flex DNA Polymerase (New England BioLabs) followed by an Agencourt Ampure XP cleanup step (Beckman Coulter Genomics). Dual-indexed Tru-Seq Illumina deep-sequencing libraries were prepared using the KAPA HTP library preparation kit (KAPA BioSystems) from ~500 ng of clean PCR product for each site-depletion experiment. The Dana-Farber Cancer Institute Molecular Biology Core performed 150-bp paired-end sequencing on an Illumina MiSeq Sequencer.

The raw FASTQ files outputted for each MiSeq run were analyzed with a Python program to determine relative PAM depletion. The program (see Methods) operates as follows: First, a file dialog is presented to the user from which all FASTQ read files for a given experiment can be selected. For these files, each FASTQ entry is scanned for the fixed spacer region on both strands. If the spacer region is found, then the six variable nucleotides flanking the spacer region are captured and added to a counter. From this set of detected variable regions, the count and frequency of each window of length 2-6 nt at each possible position was tabulated. The site-depletion data for both randomized PAM libraries was analyzed by calculating the post-selection PAM depletion value (PPDV): the post-selection frequency of a PAM in the selected population divided by the pre-selection library frequency of that PAM. PPDV analyses were performed for each experiment across all possible 2-6 length windows in the 6 bp randomized region. The windows we used to visualize PAM preferences were: the 3 nt window representing the $2^{nd}$, $3^{rd}$, and $4^{th}$ PAM positions for wild-type and variant SpCas9 experiments, and the 4 nt window representing the $3^{rd}$, $4^{th}$, $5^{th}$, $6^{th}$ PAM positions for St1Cas9 and SaCas9.

Two significance thresholds for the PPDVs were determined based on: 1) a statistical significance threshold based on the distribution of dCas9 versus pre-selection library log read count ratios (see FIGS. 13C & 13D), and 2) a biological activity threshold based on an empirical correlation between depletion values and activity in human cells. The statistical threshold was set at 3.36 standard deviations from the mean PPDV for dCas9 (equivalent to a relative PPDV of 0.85), corresponding to a normal distribution two-sided p-value of 0.05 after adjusting for multiple comparisons (i.e. p=0.05/64). The biological activity threshold was set at 5-fold depletion (equivalent to a PPDV of 0.2) because this level of depletion serves as a reasonable predictor of activity in human cells (see also FIG. 14). The 95% confidence intervals in FIG. 14 were calculated by dividing the standard deviation of the mean, by the square root of the sample size multiplied by 1.96.

Human Cell Culture and Transfection

U2OS.EGFP cells harboring a single integrated copy of a constitutively expressed EGFP-PEST reporter gene[15] were cultured in Advanced DMEM media (Life Technologies) supplemented with 10% FBS, 2 mM GlutaMax (Life Technologies), penicillin/streptomycin, and 400 µg/ml of G418 at 37° C. with 5% $CO_2$. Cells were co-transfected with 750 ng of Cas9 plasmid and 250 ng of sgRNA plasmid (unless otherwise noted) using the DN-100 program of a Lonza 4D-nucleofector according to the manufacturer's protocols. Cas9 plasmid transfected together with an empty U6 promoter plasmid was used as a negative control for all human cell experiments. Target sites for endogenous gene experiments were selected within 200 bp of NGG sites cleavable by wild-type SpCas9 (see FIG. 16A and Table 2).

Zebrafish Care and Injections

Zebrafish care and use was approved by the Massachusetts General Hospital Subcommittee on Research Animal Care. Cas9 mRNA was transcribed with PmeI-digested JDS246 (wild-type SpCas9) or MSP469 (VQR variant) using the mMESSAGE mMACHINE T7 ULTRA Kit (Life Technologies) as previously described[21]. All sgRNAs in this study were prepared according to the cloning-independent sgRNA generation method[24]. sgRNAs were transcribed by the MEGAscript SP6 Transcription Kit (Life Technologies), purified by RNA Clean & Concentrator-5 (Zymo Research), and eluted with RNase-free water.

sgRNA- and Cas9-encoding mRNA were co-injected into one-cell stage zebrafish embryos. Each embryo was injected with ~2-4.5 nL of solution containing 30 ng/4 gRNA and 300 ng/µL Cas9 mRNA. The next day, injected embryos were inspected under a stereoscope for normal morphological development, and genomic DNA was extracted from 5 to 9 embryos.

Human Cell EGFP Disruption Assay

EGFP disruption experiments were performed as previously described[16]. Transfected cells were analyzed for EGFP expression ~52 hours post-transfection using a Fortessa flow cytometer (BD Biosciences). Background EGFP loss was gated at approximately 2.5% for all experiments (graphically represented as a dashed red line).

T7E1 Assay, Targeted Deep-Sequencing, and GUIDE-Seq to Quantify Nuclease-Induced Mutation Rates T7E1 assays were performed as previously described for human cells[15] and zebrafish[21]. For U2OS.EGFP human cells, genomic DNA was extracted from transfected cells ~72 hours post-transfection using the Agencourt DNAdvance Genomic DNA Isolation Kit (Beckman Coulter Genomics). Target loci from zebrafish or human cell genomic DNA were amplified using the primers listed in Table 1. Roughly 200 ng of purified PCR product was denatured, annealed, and digested with T7E1 (New England BioLabs). Mutagenesis frequencies were quantified using a Qiaxcel capillary electrophoresis instrument (QIagen), as previously described for human cells[15] and zebrafish[21].

For targeted deep-sequencing, previously characterized on- and off-target sites (Tsai et al., Nat Biotechnol 33, 187-197 (2015); Fu et al., Nat Biotechnol 31, 822-826 (2013; Fu et al., Nat Biotechnol 32, 279-284 (2014)) were amplified using Phusion Hot-start Flex with the primers listed in Table 1. Genomic loci were amplified for a control condition (empty sgRNA), wild-type, and D1135E SpCas9. An Agencourt Ampure XP cleanup step (Beckman Coulter Genomics) was performed prior to pooling ~500 ng of DNA from each condition for library preparation. Dual-indexed Tru-Seq Illumina deep-sequencing libraries were generated using the KAPA HTP library preparation kit (KAPA BioSystems). The Dana-Farber Cancer Institute Molecular Biology Core performed 150-bp paired-end sequencing on an Illumina MiSeq Sequencer. Mutation analysis of targeted deep-sequencing data was performed as previously described (Tsai et al., Nat Biotechnol 32, 569-576 (2014)). Briefly, Illumina MiSeq paired end read data was mapped to human genome reference GRChr37 using bwa (Li et al., Bioinformatics 25, 1754-1760 (2009)). High-quality reads (quality score >=30) were assessed for indel mutations that overlapped the target or off-target sites. 1-bp indel mutations were excluded from the analysis unless they occurred within 1-bp of the predicted breakpoint. Changes in activity at on- and off-target sites comparing D1135E versus wild-type SpCas9 were calculated by comparing the indel frequencies from both conditions (for rates above background control amplicon indel levels).

GUIDE-seq experiments were performed as previously described (Tsai et al., Nat Biotechnol 33, 187-197 (2015)). Briefly, phosphorylated, phosphorothioate-modified double-stranded oligodeoxynucleotides (dsODNs) were transfected into U2OS cells with Cas9 nuclease along with Cas9 and sgRNA expression plasmids, as described above. dsODN-specific amplification, high-throughput sequencing, and mapping were performed to identify genomic intervals containing DSB activity. For wild-type versus D1135E experiments, off-target read counts were normalized to the on-target read counts to correct for sequencing depth differences between samples. The normalized ratios for wild-type and D1135E SpCas9 were then compared to calculate the fold-change in activity at off-target sites. To determine whether wild-type and D1135E samples for GUIDE-seq had similar oligo tag integration rates at the intended target site, restriction fragment length polymorphism (RFLP) assays were performed by amplifying the intended target loci with Phusion Hot-Start Flex from 100 ng of genomic DNA (isolated as described above) using primers listed in Table 1. Roughly 150 ng of PCR product was digested with 20 U of NdeI (New England BioLabs) for 3 hours at 37° C. prior to clean-up using the Agencourt Ampure XP kit. RFLP results were quantified using a Qiaxcel capillary electrophoresis instrument (QIagen) to approximate oligo tag integration rates. T7E1 assays were performed for a similar purpose, as described above.

| Software - for analyzing PAM depletion MiSeq data |
|---|

Run in the command prompt (in the directory containing the file) using the command "python PAM_depletion.py"

---

```python
import numpy as np
import pandas as pd
import glob
import fnmatch
import os
from collections import Counter
from Bio.Seq import Seq
from Bio import SeqIO
import itertools
import re
from pandas import ExcelWriter
import Tkinter, tkFileDialog
__author__ = "Ved V. Topkar"
__version__ = "1.0"
"""
IUPAC_notation_regex describes a mapping between certain base characters and the
relavent regex string
(Useful for parsing out ambiguous base strings)
"""
IUPAC_notation_regex = {
    'N' : '[ATCG]',
    'Y' : '[CT]',
    'R' : '[AG]',
    'W' : '[AT]',
    'S' : '[CG]',
    'A' : 'A',
    'T' : 'T',
    'C' : 'C',
    'G' : 'G'
}
def ambiguous_PAMs(length):
    """
    Given an inputted length, return a list of strings describing all possible PAM
sequences
    NOTE: Returned strings include ambiguous base characters
    """
    permutations = itertools.product(['N', 'A', 'T', 'C', 'G'], repeat=length)
    PAMs = [ ]
    for item in permutations:
        PAMs.append(''.join(item))
    return PAMs
def unambiguous_PAMs(length):
    permutations = itertools.product(['A', 'T', 'C', 'G'], repeat=length)
    PAMs = [ ]
    for item in permutations:
        PAMs.append(''.join(item))
    return PAMs
def regex_from_seq(seq):
    """
    Given a sequence with ambiguous base characters, returns a regex that matches
for
    the explicit (unambiguous) base characters
    """
    regex = ''
    for c in seq:
        regex += IUPAC_notation_regex[c]
    return regex
def regex_match_count(regex, list_of_counts):
    """
    Given a list of strings and a regex, return the number of strings in the list
that the regex matches.
    """
    c = 0
    for item in list_of_counts:
        if re.search(regex, item):
            c += 1
    return c
def tabulate_substring_frequencies(pams, indices):
    """
    Given a list of raw pams and substring indices, tabulates the frequency of
tabulate_substring_frequencies
    RETURNS a Pandas Series
    """
    base_PAMs = unambiguous_PAMs(indices[1] - indices[0])
    tmp_PAMs = Counter([pam[indices[0]:indices[1]] for pam in pams])
```

| Software - for analyzing PAM depletion MiSeq data |
| --- |

```
    c = Counter( )
    for base_PAM in base_PAMs:
        c[base_PAM] = tmp_PAMs[base_PAM]
    PAMs = pd.Series(c)
    PAMs.sort(ascending=False)
    excel_PAMs = pd.DataFrame( )
    excel_PAMs[ 'PAM' ] = PAMs.index
    excel_PAMs[ 'Count' ] = PAMs.values
    excel_PAMs[ 'Frequency' ] = PAMs.values.astype(float)/sum(PAMs.values)
    return excel_PAMs
def generate_raw_PAM_counts(filepaths, targetsites, PAM_length):
    """
    Here, we get all of our relavent PAM sequences from the inputted files
    by searching for the targetsites and looking at the flanking region
    """
    reverse_target_sequences = {targetsite:
str(Seq(targetsites[targetsite]).reverse_complement( )) for targetsite in
targetsites}
    all_pams = {targetsite: [ ] for targetsite in targetsites}
    # Iterate through each file and collect the PAMs of each sequence
    # Checks both forward and reverse reads
    for filepath in filepaths:
        print 'Scanning file: ' + os.path.basename(filepath)
        pams = [ ]
        records = SeqIO.parse(filepath, filepath.split('.') [−1])
        for record in records:
            seq = str(record.seq)
            for targetsite in targetsites:
                target_seq = targetsites[targetsite]
                target = seq.find(targetsites[targetsite])
                if target > −1:
                    index = target + len(target_seq)
                    all_pams[targetsite].append(seq[index:index + PAM_length])
                else:
                    target = seq.find(reverse_target_sequences[targetsite])
                    if target > −1:
                        index = target
                        all_pams[targetsite].append(str(Seq(seq[index −
PAM_length:index]).reverse_complement( )))
    return all_pams
def analyze_PAM_depletion_data(filepaths, targetsites, PAM_length=3):
    """
    Given a directory that contains a given file extension and a target sequence,
    do the entire PAM depletion analysis
    """
    # Make sure that dirnames and target sequences are inputted
    if filepaths is None:
        raise Exception('Please specify a directory name')
    if targetsites is None:
        raise Exception('Please specify a target sequence')
    if PAM_length is None or PAM_length < 3:
        raise Exception('Please enter a valid PAM length')
    all_pams = generate_raw_PAM_counts(filepaths, targetsites, PAM_length)
    letters = ['A', 'T', 'C', 'G']
    all counters = {targetsite: Counter(all_pams[targetsite]) for targetsite in
targetsites}
    for targetsite in targetsites:
        pams = all_pams[targetsite]
        base_counters = [Counter( ) for x in range(PAM_length)]
        for pam in pams:
            for i, c in enumerate(pam):
                base_counters[i][c] += 1
        raw_PAM_counts = pd.Series(all_counters[targetsite])
        raw_PAM_counts.sort(ascending=False)
        raw_counts_df = pd.DataFrame( )
        raw_counts_df['PAM'] = raw_PAM_counts.index
        raw_counts_df['Count'] = raw_PAM_counts.values
        single_base_counts = pd.DataFrame(base_counters)
        single_base_frequencies =
single_base_counts.divide(single_base_counts.sum(axis=1).ix[0])
        # Prepare substring counts and frequencies
        writer = ExcelWriter('out/' + os.path.basename(filepath).split('.')[0] +
'_' + targetsite + '.xlsx')
        single_base_counts.to_excel(writer, 'Single Base Counts')
        single_base_frequencies.to_excel(writer, 'Single Base Frequencies')
        raw_counts_df.to_excel(writer, 'Raw PAM Counts')
        # Designate which windows should be analyzed and name them
```

Software - for analyzing PAM depletion MiSeq data

```
    settings = {
        'XXXNNN': [0,3],
        'NXXXNN': [1,4],
        'NNXXXN': [2,5],
        'NNNXXX': [3,6],
        'XXXXNN': [0,4],
        'NXXXXN': [1,5],
        'NNXXXX': [2,6],
        'XXNNNN': [0,2],
        'NXXNNN': [1,3],
        'NNXXNN': [2,4],
        'NNNXXN': [3,5],
        'NNNNXX': [4,6],
        'XXXXXN': [0,5],
        'NXXXXX': [1,6],
        'XXXXXX': [0,6],
    }
    for item in settings:
        df = tabulate_substring_frequencies(pams, settings[item])
        df.to_excel(writer, item)
    writer.save( )
    print 'Saved excel output for ' + targetsite
if __name__ == "__main__":
    # Display the filepicker, accepting only FASTQ files
    root = Tkinter.Tk( )
    root.withdraw( )
    file_paths = tkFileDialog.askopenfilenames(parent=root, title='Choose FASTQ
files', filetypes=[("FastQ files", "*.fastq")])
    # Describe the targetsite(s) to search for
    targetsites = {'EGFP site 1': 'GTCGCCCTCGAACTTCACCT'}
    # Run the analysis on the inputted filepaths and targetsite for a given
variable nucleotide region length
    analyze_PAM_depletion_data(file_paths, targetsites, PAM_length=6)
```

Example 1

One potential solution to address targeting range limitations would be to engineer Cas9 variants with novel PAM specificities. A previous attempt to alter PAM specificity utilized structural information about base-specific SpCas9-PAM interactions to mutate arginine residues (R1333 and R1335) that contact guanine nucleotides at the second and third PAM positions, respectively (Anders et al., Nature 513, 569-573 (2014)). Substitution of both arginines with glutamines (whose side-chains might be expected to interact with adenines) failed to yield SpCas9 variants that could cleave targets harboring the expected NAA PAM in vitro (Anders et al., Nature 513, 569-573 (2014)). Using a human cell-based U2OS EGFP reporter gene disruption assay in which nuclease-induced indels lead to loss of fluorescence (Reyon et al., Nat Biotechnol 30, 460-465 (2012); Fu et al., Nat Biotechnol 31, 822-826 (2013)), we confirmed that an R1333Q/R1335Q SpCas9 variant failed to efficiently cleave target sites with NAA PAMs (FIG. 1A). Additionally, we found that single R1333Q and R1335Q SpCas9 variants each failed to efficiently cleave target sites with their expected NAG and NGA sites, respectively (FIG. 1A). We therefore reasoned that re-engineering PAM specificity might require additional mutations at positions other than R1333 and R1335. For example, available structural information shows that K1107 and S1136 make direct and indirect minor groove contacts to the second and third bases in the PAM, respectively (Anders et al., Nature 513, 569-573 (2014)). Therefore, it is plausible that additional alterations at or near these positions might be needed to alter PAM specificity.

To identify additional positions that might be critical for modifying PAM specificity, we adapted a bacterial selection system previously used to study properties of homing endonucleases (hereafter referred to as the positive selection) (Chen & Zhao, Nucleic Acids Res 33, e154 (2005); Doyon et al., J Am Chem Soc 128, 2477-2484 (2006)). In our adaptation of this system, Cas9-mediated cleavage of a positive selection plasmid encoding an inducible toxic gene enables cell survival, due to subsequent degradation and loss of the linearized plasmid (FIG. 1B and FIG. 12A). After establishing that SpCas9 can function in the positive selection system, we tested both wild-type and the R1335Q variant for their ability to cleave a selection plasmid harboring a target site with an NGA PAM and failed to observe survival, as expected (FIG. 12A). To screen for gain-of-function mutations, we generated libraries of wild-type and R1335Q SpCas9 bearing randomly mutagenized PAM-interacting domains (amino acid positions 1097-1368) with a mean rate of 5.2 mutations per kilobase (FIG. 12B and Methods). These libraries were introduced into bacteria with a positive selection plasmid containing a target site with an NGA PAM and plated on selective medium. Sequences of surviving clones from the R1335Q-based library revealed that the most frequent substitutions in addition to the pre-existing R1335Q mutation were D1135V/Y/N/E and T1337R (Table 3). We obtained fewer survivors with the wild-type SpCas9-based library selection but the sequences of these clones also included D1135V/Y/N and R1335Q mutations. We next assembled and tested SpCas9s bearing all possible single, double, and triple combinations of the D1135V/Y/N/E, R1335Q, and T1337R mutations using the human cell-based EGFP disruption assay. This analysis showed that SpCas9 variants with substitutions at all three positions displayed the highest activities on an NGA PAM, but also the lowest activities on an NGG PAM (FIG. 1C). We chose two SpCas9 variants, D1135V/R1335Q/T1337R and D1135E/R1335Q/T1337R (hereafter referred to as the VQR and EQR SpCas9 variants, respectively), because they possessed the greatest discrimination between NGA and NGG PAMs (FIG. 1C), for further characterization.

To assess the global PAM specificity profiles of our novel SpCas9 variants, we used a bacterial-based negative selection system (FIG. 1D and FIG. 13A). Previous studies have used similar types of selection systems to identify the cleavage site preferences of Cas9 nucleases (Jiang et al., Nat Biotechnol 31, 233-239 (2013); Esvelt et al., Nat Methods 10, 1116-1121 (2013)). In our version of this assay (which we refer to as the site-depletion assay), a library of plasmids bearing randomized 6 bp sequences placed adjacent to a protospacer is tested for cleavage by a Cas9/sgRNA complex in E. coli (FIG. 13B). Plasmids with protospacer-adjacent sequences resistant to cleavage by a Cas9/sgRNA complex enable cell survival due to the presence of an antibiotic resistance gene, whereas plasmids bearing cleavable sequences are degraded and therefore depleted from the library (FIG. 13B). High-throughput sequencing of ~100,000 non-targetable sequences enabled us to calculate a post-selection PAM depletion value (PPDV) for any given PAM. The PPDV of a PAM (or group of PAMs) is defined as the frequency of that PAM in the post-selection population divided by its frequency in the pre-selection library. This quantitative value provides an estimate of Cas9 activity on that PAM. Profiles obtained with catalytically inactive Cas9 (dCas9) on two randomized PAM libraries (each with a different protospacer) enabled us to define what represents a statistically significant change in PPDV for any given PAM or group of PAMs (FIG. 13C). We then validated our site-depletion assay by demonstrating that the PPDVs for wild-type SpCas9 obtained with the two randomized PAM libraries recapitulated its previously described profile of targetable PAMs (Jiang et al., Nat Biotechnol 31, 233-239 (2013)) (FIG. 1E).

Using the site-depletion assay, we obtained PAM specificity profiles for the VQR and EQR SpCas9 variants using the two randomized PAM libraries. The VQR variant strongly depleted sites bearing NGAN and NGCG PAMs, and more weakly NGGG, NGTG, and NAAG PAMs (FIG. 1F). In contrast, the EQR variant strongly depleted NGAG PAMs and more weakly NGAT, NGAA, and NGCG PAMs (FIG. 1F), demonstrating a potentially more limited targeting range relative to the VQR variant. To test whether PAMs identified by the site-depletion assay could also be recognized in human cells, we assessed cleavage by the VQR and EQR SpCas9 variants on target sites using the EGFP disruption assay. The VQR variant robustly cleaved sites in EGFP bearing NGAN PAMs (with relative efficiencies NGAG>NGAT=NGAA>NGAC), and also sites bearing NGCG, NGGG, and NGTG PAMs with generally lower efficiencies (FIG. 1G). The EQR variant also recapitulated its preference for NGAG and NGNG PAMs over the other NGAN PAMs in human cells, again all at lower activities than with the VQR variant (FIG. 1G). Collectively, these results in human cells strongly mirror what was observed with the bacterial site-depletion assay (FIG. 14) and suggested that PPDVs of 0.2 (representing a five-fold depletion) in the bacterial assay provide a reasonable predictive threshold for activity in human cells (FIG. 14).

We next sought to extend the generalizability of our engineering strategy by attempting to identify SpCas9 variants capable of recognizing an NGC PAM. We first designed Cas9 mutants bearing amino acid substitutions of R1335 that might be expected to interact with a cytosine (D, E, S, or T) and found no activity on an NGC PAM site using the positive selection system. We then randomly mutagenized the PAM-interacting domain of each of these singly substituted SpCas9 variants but still failed to obtain surviving colonies in positive selections. Because the T1337R mutation had increased the activities of our VQR and EQR SpCas9 variants (FIG. 1C), we combined this mutation with R1335 substitutions of A, D, E, S, T, or V, and again randomly mutagenized their PAM-interacting domains. Selections using two of these six mutagenized libraries (bearing pre-existing R1335E/T1337R and R1335T/T1337R substitutions) yielded surviving colonies harboring a variety of additional mutations (Table 3). Characterization of various selected clones using both bacterial and human cell-based assays suggested that substitutions at four positions in particular (D1135V, G1218R, R1335E, and T1337R) appeared to be important for cleavage of NGC PAMs. Assembly and testing of all potential single, double, triple, and quadruple combinations of these mutations using the EGFP disruption assay established that the quadruple VRER variant displayed the highest activity on an NGCG PAM and minimal activity on an NGGG PAM (FIG. 1H). Analysis of the VRER variant using the site-depletion assay revealed it to be highly specific for NGCG PAMs (FIG. 1I). Consistent with this result, EGFP disruption assays performed in human cells with the VRER variant revealed efficient cleavage of sites with NGCG PAMs, greatly decreased and inconsistent cleavage of sites with NGCA, NGCC, and NGCT PAMs, and essentially no activity on sites with NGAG, NGTG, and NGGG PAMs (FIG. 1J).

To demonstrate directly that our VQR and VRER SpCas9 variants can enable targeting of sites not currently modifiable by wild-type SpCas9, we tested their activities on endogenous genes in zebrafish embryos and human cells. In single cell zebrafish embryos, we found that the VQR variant could efficiently modify endogenous gene sites bearing NGAG PAMs with mean mutagenesis frequencies of 20 to 43% (FIG. 2A) and that the indels originated at the predicted cleavage sites (FIG. 15). In human cells, we found that the VQR variant robustly modified 16 sites across four different endogenous genes that harbored NGAG, NGAT, and NGAA PAMs (range of 6 to 53%, mean of 33%; FIG. 2B and FIG. 16A). Importantly, we verified that wild-type SpCas9 was unable to efficiently alter most of the same sites with NGAG and NGAT PAMs in zebrafish and human cells (FIGS. 2A and 2C), yet was able to efficiently modify nearby sites bearing NGG PAMs (FIG. 16B). Similarly, when examining VRER variant activity at nine sites with NGCG PAMs across three endogenous human genes, we also observed robust mean disruption frequencies (range of 5 to 36%, mean of 21%; FIG. 2D). Consistent with our site-depletion data (FIGS. 1E & 1F), the VQR variant altered NGCG PAM sites efficiencies similar to that observed with the VRER variant, while wild-type SpCas9 was unable to do so (FIG. 2D). Computational analysis of the reference human genome sequence shows that the addition of our VQR and VRER SpCas9 variants doubles the range of potential target sites compared with what was previously possible with only wild-type SpCas9 (FIG. 2E). Taken together, these results demonstrate that our engineered SpCas9 variants expand the targeting range of SpCas9 by enabling modification of previously inaccessible endogenous sites in zebrafish embryos and human cells.

To determine the genomewide specificity of our VQR and VRER SpCas9 nucleases, we used the recently described GUIDE-seq (Genome-wide Unbiased Identification of Double-stranded breaks Enabled by sequencing) method[10]

to profile off-target cleavage events of these SpCas9 variants in human cells. We profiled the genome-wide activities of the VQR and VRER SpCas9 variants using a total of 13 different sgRNAs (eight for VQR and five for VRER from FIGS. 2B and 2D, respectively), which we had shown could induce high efficiencies of modification at their intended on-target sites. These GUIDE-seq experiments yielded a number of important observations: The numbers of off-target DSBs induced by our SpCas9 variants in human cells are comparable to (or, in the case of the VRER variant, perhaps even better than) what has been previously observed with wild-type SpCas9 (FIG. 2F). We note that the high genome-wide specificities observed with VRER might result both from its restricted specificity for NGCG PAMs and perhaps from the relative depletion of sites with NGCG PAMs in the human genome (FIG. 2E)[21]. Additionally, the off-target sites observed generally possess the expected PAM sequences predicted by our site-depletion experiments, including some tolerance for PAMs "shifted" 3' by one base (compare PAMs from FIGS. 1F and 1I with those in the sites of FIG. 17). Finally, the position and numbers of mismatches found in the off-target sites of our VQR and VRER SpCas9 variants (FIG. 17) are similar in their distributions to what we previously observed with wild-type SpCas9 for sgRNAs targeted to non-repetitive sequences[10].

Previous studies have shown that imperfect PAM recognition by SpCas9 can lead to recognition of unwanted sites that contain non-canonical NAG, NGA, and other PAMs in human cells (Hsu et al., Nat Biotechnol 31, 827-832 (2013); Tsai et al., Nat Biotechnol 33, 187-197 (2015); Jiang et al., Nat Biotechnol 31, 233-239 (2013); Mali et al., Nat Biotechnol 31, 833-838 (2013); Zhang et al., Sci Rep 4, 5405 (2014)). Therefore, we were interested in exploring if mutations at or near residues that mediate PAM-interaction might improve SpCas9 PAM specificity. While engineering the VQR variant we had noticed that a D1135E SpCas9 mutant appeared to better discriminate between a canonical NGG PAM and a non-canonical NGA PAM compared to wild-type SpCas9 (FIG. 1C). Given this observation, we comprehensively assessed the PAM recognition profile of this D1135E variant using our site-depletion assay. This experiment revealed a decrease in depletion of non-canonical NAG, NGA, and NNGG PAMs with D1135E SpCas9 relative to wild-type SpCas9 (FIG. 3A). Interestingly, this effect was more prominent for one of the two protospacers we used, suggesting that the impact of the D1135E substitution on non-canonical PAM recognition may vary to some degree in a protospacer-dependent manner. Importantly, we did not observe the emergence of any new non-canonical PAM specificities.

We next tested whether the improved PAM specificity of D1135E SpCas9 also could be observed in human cells. In direct comparisons of wild-type and D1135E SpCas9 on eight target sites with non-canonical NAG or NGA PAMs, we observed that these sites were consistently less efficiently cleaved by D1135E than by wild-type SpCas9 in the EGFP disruption assay (FIG. 3B, mean fold-decrease in activity of 1.94). Importantly, wild-type and D1135E SpCas9 both showed comparable activities on four EGFP reporter gene sites and six endogenous human gene sites with canonical NGG PAMs (FIGS. 3B and 3C, respectively), demonstrating that the D1135E variant does not appreciably affect cleavage of on-target sites with NGG PAMs (mean fold-decrease in activity of 1.04 across all ten sites). Titration experiments in which we decreased the concentration of Cas9-encoding plasmid transfected into human cells revealed no substantial differences in the activities of wild-type and D1135E SpCas9 when they were targeted to the same sites (FIG. 3D), implying that the increased specificity observed with the D1135E variant is not simply the result of protein destabilization.

To more directly assess whether the introduction of D1135E could reduce off-target cleavage effects of SpCas9, we used deep-sequencing to compare mutation rates induced by wild-type and D1135E SpCas9 on 25 previously known off-target sites of three different sgRNAs (Hsu et al., Nat Biotechnol 31, 827-832 (2013); Tsai et al., Nat Biotechnol 33, 187-197 (2015); Fu et al., Nat Biotechnol 31, 822-826 (2013)). These 25 sites included off-target sites with various mismatches in the spacer sequence and both canonical NGG and non-canonical PAMs (FIG. 3E). The results of these deep-sequencing experiments revealed that the D1135E variant showed reduced mutation frequencies at 19 of the 22 off-target sites with activity above background indel rates, relative to the mutation frequency observed at the three on-target sites (FIGS. 3E & 3F). Interestingly, these reduced off-target mutation frequencies were observed at many sites with a canonical PAM, suggesting that the gain in specificity with D1135E is not restricted only to sites with non-canonical PAMs. To assess the improvements in specificity associated with D1135E on a genome-wide scale, we performed GUIDE-seq experiments using wild-type and D1135E SpCas9 with three different sgRNAs (two of which were previously known to have off-target sites with canonical and non-canonical PAMs (Hsu et al., Nat Biotechnol 31, 827-832 (2013); Tsai et al., Nat Biotechnol 33, 187-197 (2015); Fu et al., Nat Biotechnol 31, 822-826 (2013)). We observed a generalized improvement in genome-wide specificity when using the D1135E SpCas9 variant compared with wild-type SpCas9 (FIG. 3G). For all three sgRNAs we tested, these improvements in specificity were observed at off-target sites that contained mismatched spacers with canonical or non-canonical PAMs (FIG. 18). Importantly, these GUIDE-seq experiments demonstrated that the introduction of the D1135E mutation does not increase the number of off-target effects induced by SpCas9. Collectively, these results show that the D1135E substitution can increase the global specificity of SpCas9.

Although all of the experiments described above were performed with SpCas9, there are many Cas9 orthologues from other bacteria that could make attractive candidates for characterizing and engineering Cas9s with novel PAM specificities (Fonfara et al., Nucleic Acids Res 42, 2577-2590 (2014); Ran et al., Nature 520, 186-191 (2015)). To explore the feasibility of doing this, we determined whether two smaller-size orthologues, Streptococcus thermophilus Cas9 from the CRISPR1 locus (St1Cas9) (Deveau et al., J Bacteriol 190, 1390-1400 (2008); Horvath et al., J Bacteriol 190, 1401-1412 (2008)) and Staphyloccocus aureus (SaCas9) (Hsu et al., Cell 157, 1262-1278 (2014); Ran et al., Nature 520, 186-191 (2015)), might also function in our bacterial selection assays. While the PAM of St1Cas9 has previously been characterized as NNAGAA (SEQ ID NO:3) (Esvelt et al., Nat Methods 10, 1116-1121 (2013); Fonfara et al., Nucleic Acids Res 42, 2577-2590 (2014); Deveau et al., J Bacteriol 190, 1390-1400 (2008); Horvath et al., J Bacteriol 190, 1401-1412 (2008)), our attempts to bioinformatically derive the SaCas9 PAM using a previously described approach (Fonfara et al., Nucleic Acids Res 42, 2577-2590 (2014)) failed to yield a consensus sequence (data not shown). Therefore, we used our site-depletion assay to determine the PAM for SaCas9 and, as a positive control, for St1Cas9. These experiments were performed using the two different protospacers and sgRNAs with two different complementarity lengths for each protospacer, resulting in four selections for each Cas9. For St1Cas9, we identified two novel PAMs in addition to the six PAMs that had been previously described (Esvelt et al., Nat Methods 10, 1116-1121 (2013); Fonfara et al., Nucleic Acids Res 42, 2577-2590 (2014); Horvath et al., J Bacteriol 190, 1401-1412 (2008)) (FIG. 4A and FIGS. 19C and 19d, consistent with a recent definition of SaCas9 PAM specificity (Ran et al., Nature 520, 186-191 (2015))). For SaCas9, there was PPDV variability among the four selections mainly due to the restricted PAM preferences observed with one protospacer. As a result, only three PAMs were depleted greater than 5-fold in all four experiments: NNGGGT (SEQ ID NO:4), NNGAAT (SEQ ID NO:6), NNGAGT (SEQ ID NO:5) (FIG. 4B). We did, however, identify many more targetable PAMs with the second protospacer library, implying that SaCas9 might recognize numerous additional PAMs (FIGS. 18C and 18D). Using PAMs identified in our site-depletion experiments (NNAGAA (SEQ ID NO:3) for St1Cas9 and NNGAGT (SEQ ID NO:5) for SaCas9), we found that both St1Cas9 and SaCas9 can function efficiently in the bacterial positive selection system (FIG. 4C), suggesting that their PAM specificities could be modified by mutagenesis and selection.

Because not all Cas9 orthologues function efficiently outside of their native context (Esvelt et al., Nat Methods 10, 1116-1121 (2013)), we tested whether St1Cas9 and SaCas9 can robustly cleave target sites in human cells. St1Cas9 has been previously shown to function as a nuclease in human cells but on only a few sites (Esvelt et al., 2013; Cong et al., Science 339, 819-823 (2013)). We assessed St1Cas9 activity on sites harboring NNAGAA (SEQ ID NO:3) PAMs using sgRNAs with variable-length complementarity regions and found high activity at three of the five target sites (FIG. 4D). For SaCas9, we observed efficient activity at eight sites harboring NNGGGT (SEQ ID NO:4) or NNGAGT (SEQ ID NO:5) PAMs (FIG. 4E). For both St1Cas9 and SaCas9 no obvious correlation between activity and length of spacer complementarity was observed (FIG. 19E). We next determined whether St1Cas9 and SaCas9 could efficiently modify endogenous loci in human cells. For St1Cas9, 7 out of 11 sites across 4 genes were disrupted efficiently as judged by T7E1 assay (1 to 25%, mean of 13%; FIG. 4F), while SaCas9 displayed somewhat more robust activities at 16 sites tested across 4 genes (1% to 37%, mean of 19%; FIG. 4G). Once again, no distinct trend was observed when considering sgRNA spacer length for St1Cas9 and SaCas9 (FIG. 19F). Collectively, our results show that St1Cas9 and SaCas9 function robustly both in our bacterial-based selection and in human cells, making them attractive candidates for engineering additional SpCas9 variants with novel PAM specificities.

TABLE 3

| | SEQ ID NO: |
|---|---|
| Wild-type SpCas9 sequence from K1097-D1368 of SEQ ID NO: 1 | |
| KTEVQTGGFSKESILPKRNSDKLIARKKDWDPKKYGGFDSPTVAYSVLVVAKVEKGKSKKLKSVKELLGITI MERSSFEKNPIDFLEAKGYKEVKKDLIIKLPKYSLFELENGRKRMLASAGELQKGNELALPSKYVNFLYLAS HYEKLKGSPEDNEQKQLFVEQHKHYLDEIIEQISEFSKRVILADANLDKVLSAYNKHRDKPIREQAENIIHLF TLTNLGAPAAFKYFDTTIDRKRYTSTKEVLDATLIHQSITGLYETRIDLSQLGGD | aa 1097-1368 of SEQ ID NO: 1 |
| Selected mutant clones for VQR and EQR variant, sequence from K1097-D1368 | |
| KTEVQTGGFSKESILPKRNSDKLIARKKDWDPKKYGGFDSPTVAYSVLVVAKVEKGKSKKLKSVKELLGITI MERSSFEKNPIDFLEAKGYKEVKKDLIIKLPKYSLFELENGRKRMLASAGELQKGNELALPSKYVNFLYLAS HYEKLKGSPEDNEQKQLFVEQHKHYLDEIIEQISEFSKRVILADANLDKVLSAYNKHRDKPIREQAENIIHLF TLTNLGAPAAFKYFDTTIDRKRYTSTKEVLDATLIHQSITGLYETRIDLSQLGGD | 431. |
| KTEVQTGGFSKESILPKRNSDKLIARKKDWDPKKYGGFYSPTVAYSVLVVAKVEKGKSKKLKSVKELLGITI MERSSFEKNPIDFLEAKGYKEVKKDLIIKLPKYSLFELENGRKRMLASAGELQKGNELALPSKYVNFLYLAS HYEKLKGSPEDNEQKQLFVEQHKHYLDEIIEQISEFSKRVILADANLDKVLSAYNKHRDKPIREQAENIIHLF TLTNLGAPAAFKYFDTTIDRKRYISTKEVLDATLIHQSITGLYETRIDLSQLGGD | 432. |
| KTEVQTGGFSKESILPKRNSDKLIARKKDWDPKKYGGFNSPTVAYSVLVVAKVEKGKFKKLKSVKELLGITI MERSSFEKNPIDFLEAKGYKEVKKDLIIKLPKYSLFELENGRKRMLASAGELQKGNELALPSKYVNFLYLAS HYEKLKGSPEDNEQKQLFVEQHKHYLDEIIEQISEFSKRVILADANLDKVLSAYNKHRDKPIREQAENIIHLF TLTNLGAPAAFKYFDTTIDRKQYTSTKEVLDATLIHQSITGLYETRIDLSQLGGD | 433. |
| KTEVQTGGFSKESILPKRNSDKLIARKKDWDPKKYGGFYSPTVAYSVLVVAKVEKGKSKKLKSVKELLGITI MERSSFEKNPIDFLEAKGYKEVKKDLIIKLPKYSLFELENGRKRMLASAGELQKGNELALPSKYVNFLYLAS HYEKLKGSPEDNEQKQLFVEQHKHYLDEIIEQISEFSKRVILADANLDKVLSAYNKHRDKPIREQAENIIHLF TLTNLGAPAAFKYFDTTIDRKRYTSTKEVLDATLIHQSITGLYETRIDLSQLGGD | 434. |
| KTEVQTGGFSKESILPKRNSDKLIARKKDWDPKKYGGFNSPTVAYSVLVVAKVEKGKSKKLKSVKELLGITI MERSSFEKNPIDFLEAKGYKEVKKDLIIKLPKYSLFELENGRKRMLASAGELQRGNELALPSKYVNFLYLAS HYEKLKGSPEDNEQKQLFVEQHKHYLDEIIEQISEFSKRVILADANLDKVLSAYNKHRDKPIREQAENIIHLF TLTNLGAPAAFKYFDTTIDRKRYTSTKEVLDATLIHQSITGLYETRIDLSQLGGD | 435. |
| KTEVQTGGFSKESILPKRNSDKLIARKKDWDPKKYGGFVSPTVAYSVLVVAKVEKGKSKKLKSVKELLGITI MERSSFEKNPIDFLEAKGYKEVKKDLIIKLPKYSLFELENGRKRMLASAGELQKGNELALPSKYVNFLYLAS HYEKLKGSPEDNEQKQLFVEQHKHYLDEIIEQISEFSKRVILADANLDKVLSAYNKHRDNPIREQAENIIHL FTLTNLGAPAAFKYFDTTIDRKRYTSTKEVLDATLIHQSITGLYETRIDLSQLGGD | 436. |

TABLE 3-continued

| | SEQ ID NO: |
|---|---|
| KTEVQTGGFSKESILPKRNSDKLIARKKDWDPKKYGGFDSPTVAYSVLVVAKVEKGKSKKLKSVKELLGITI MERSSFEKNPIDFLEAKGYKEVKKDLIIKLPKYSLFELENGRKRMLASAGELQKGNELALPSKYVNFLYLAS HYEKLKGSPEDNEQKQLFVEQHKHYLDEIIEQISEFSKRVILADANLDKVLSAYNKHRDKPIREQAENIIHLF TLTNLGAPAAFKYFDTPIDRKRYTSTKEVLDATLIHQSITGLYETRIDLSQLGGD | 437. |
| KTEVQTGGFSKESILPKRNSDKLIARKKDWDPKKYGGFYSPTVAYSVLVVAKVEKGKSKKLKSVKELLGITI MERSSFEKNPIDFLEAKGYKEVKKDLIIKLPKYSLFELENGRKRMLASAGELQKGNELALPSKYVNFLYLAS HYEKLKGSPEDNEQKQLFVEQHKHYLDEIIEQISEFSKRVILADANLDKVLSAYNKHRDKPIREQAENIIHLF TLTNLGAPAAFKYFDTTIDRKQYTSTKEVLDATLIHQSITGLYETRIDLSQLGGD | 438. |
| KTEVQTGGFSKESILPKRNSDKLIARKKDWDPKKYGGFVSPTVAYSVLVVAKVEKGKSKKLKSVKELLGITI MERSSFEKNPIDFLEAKGYKEVKKDLIIKLPKYSLFELENGRKRMLASAGELQKGNELALPSKYVNFLYLAS HYEKLKGSPEDNEQKQLFVEQHKHYLDEIIEQISEFSKRVILADANLDKVLSAYNKHRDKPIREQAENIIHLF TLTKLGAPAAIKYFDTTIDRKQYTSTKEVLDATLIHQSITGLYETRIDLSQLGGD | 439. |
| KTEVQTGGFSKESILPKRNSDKLIARKKDWDPKKYGGFYSPTVAYSVLVVAKVEKGKSKKLKSVKELLGITI MERSSFEKNPIDFLEAKGYKEVKKDLIIKLPKYSLFELENGRKRMLASAGELQKGNELALPSKYVNFLYLAS HYEKLKGSPEDNEQKQLFVEQHKHYLDEIIEQISEFSKRVILADANLDKVLSAYNKHRDKPIREQAENIIHLF TLTNLGAPAAFKYFDTTIDRKQYTSTKEVLEATLIHQSITGLYETRIDLSQLGGD | 440. |
| KTEVQTGGFSKESILPKRNSDKLIARKKDWDPKKYGGFYSPTVAYSVLVVAKVEKGKSKKLKSVKELLGITI MERSSFEKNPMDFLEAKGYKEVKKDLIIKLPKYSLFELENGRKRMLASAGELQKGNELALPSKYVNFLYLA SHYEKLKGSPEDNEQKQLFVEQHKHYLDEIIEQISEFSKRVILADANLDKVLSAYNKHRDKPIREQAENIIHL FTLTNLGAPAAFKYFDTTIDRKQYTSTKEVLDATLIHQSITGLYETRIDLSQLGGD | 441. |
| KTEVQTGGFSKESILPKRNSDKLIARKKDWDPKKYGGFVSPTVAYSVLVVEAKVEKGKSKKLKSVKELLGITI MERSSFEKNPIDFLEAKGYKEVKKDLIIKLPKYSLFELENGRKRMLASAGELQKGNELALPSKYVNFLYLAS HYEKLKGSPEDNEQKQLFVEQHKHYLDEIIEQISEFSKRVILADANLDKVLSAYNKHRDKPIREQAENIIHLF TLTNLGAPAAFKYFDTTIDRKQYTSTKEVLDATLIHQSITGLYETRIDLSQLGGD | 442. |
| KTEVQTGGFSKESILPKRNSDKLIARKKDWDPKKYGGFESPTVAYSVLVVAKVEKGKSKKLKSVKELLGITI MERSSFEKNPIDFLEAKGYKEVKKDLIIKLPKYSLFELENGRKRMLASAGELQKGNELALPFKYVNFLYLAS HYEKLKGSPEDNEQKQLFVEQHKHYLDEIIEQISEFSKRVILADANLDKVLSAYNKHRDKPIREQAENIIHLF TLTNLGAPSAFKYFDTTIDRKQYRSTKEVLDATLIHQSITGLYETRIDLSQLGGD | 443. |
| KTEVQTGGFSKESIFPKRNSDKLIARKKDWDPKKYGGLYSPTVAYSVLVVAKVEKGKSKKLKSVKELLGITI MERSSFEKNPIDFLEAKGYKEIKKDLIIKLPKYSLFELENGRKRMLASAGELQKGNELALPSKYVNFLYLASH YEKLKGSPEDNEQKQLFVEQHKHYLDEIIEQISEFSKRVILADANLDKVLSAYNKHRDKPIREQAENIIHLFT LTNLGAPAAFKYFDTTIDRKQYTSTKEVLDATLIHQSITGLYETRIDLSQLGGD | 444. |
| KTEVQTGGFSKESILPKRNSDKLIARKKDWDPKKYGGFYSPTVAYSVLVVAKVEKGKSKKLKSVKELLGITI MERSSFEKNPIDFLEAKGYKEVKKDLIIKLPKYSLFELENGRKRMLASAGELQKGNELALPSKYVNFLYLAS HYEKLKGSPEDKEQKQLFVEQHKHYLDEIIEQISEFSKRVILADANLDKVLSAYNKHRDKPIREQAENIIHLF TLTNLGAPAAFKYFDTTIDRKQYTSTKEVLDATLIHQSITGLYETRIDLSQLGGD | 445. |
| KTEVQTGGFSKESILPKRNSDKLIARKKDWDPKKYGGFYSPTVAYSVLVVAKVEKGKSKKLKSVKELLGITI MERSSFEKNPIDFLEAKGYKEVKEDLIIKLPKYSLFELENGRKRMLASAGELQKGNELALPSKYVNFLYLAS HYEKLKGSPEDNEQKQLFVEQHKHYLDEIIEQISEFSKRVILADANLDKVLSAYNKHRDKPICEQAENIIHLF TLTNLGAPAAFKYFDTTIDRKQYTSTKEVLDATLIHQSITGLYETRIDLSQLGGD | 446. |
| KTEVQTGGFSKESILPKRNSDKLIARKKDWDPKKYGGFYSPTVAYSVLVVAKVENRKSKKLKSVKELLGITI MERSSFEKNPIDFLEAKGYKEVKKDLIIKLPKYSLFELENGRKRMLASARELQKGNELALPSKYVNFLYLAS HYEKLKGSPEDNEQKQLFVEQHKHYLDEIIEQISEFSKRVILADANLDKVLSAYNKHRDKPIREQAENIIHLF TLTNLGAPAAFKYFDATIDRKQYTSTKEVLDATLIHQSITGLYETRIDLSQLGGD | 447. |
| KTEVQTGGFSKESILPKRNSDKLIARKKDWDPKKYGGFVSPTVAYSVLVVANVEKGKSKKLKSVKELLGITI MERSSFEKNPIDFLEAKGYKEVKKDLIIKLPKYSLFELENGRKRMLASAGELQKGNELALPSKYVNFLYLAS HYEKLKGSPEDNEQKQLFVEQHKHYLDEIIEQISEFSKRVILTDANLDKVLSAYNKHRDKPIREQAENIIHLF TLTNLGAPAAFKYFDTTIDRKQYTSTKEVLDATLIHQSITGLYETRIDLSQLGGD | 448. |
| KTEVQTGGFSKESILPKRNSDKLIARKKDWDPKKYGGFYSPTVAYSVLVVAKVEKGKSKKLKSVKELLGITI MERSSFEKNPIDFLEAKGYKEVKKDLIIKLPKYSLFELENGRKRMLASAGELQKGNELALPSKYVNFLYLAS HYEKLKGSLEDNEQKQLFVEQHRHYLDEIIEQISEFSKRVILADANLDKVLSAYNKYRDKPIREQAENIIHLF TLTNLGAPAAFKYFDTTIDRKQYTSTKEVLDATLIHQSITGLYETRIDLSQLGGD | 449. |
| KTEVQTGGFSKESILPKRNSDKLIARKKVWDPKKYGGFYSPTVAYSVLVVAKVEKGKSKKLKSVKELLGITI MERSSFEKNPIDFLEAKGYKEVKKDLIIKLPKYSLFELENGRKRMLASAGELQKGNELALPSKYVNFLYLAS HYEKLKGSPEDNEQKQLFVEQHKHYLDEIIEQISEFSKRVILADANLDKVLSAYNKHRDKPIREQAENIIHLF TLTNLGAPAAFKYFDTTIDRKQYTSTKEVLDATLIHQSITGLYETRIDLSQLGGD | 450. |
| KTEVQTGGFSKESILPKRNSDKLIARKKDWDPKKYGGFYSPTVAYSILVVAKVEKGKSKKLKSVKELLGITI MERSSFEKNPIDFLEAKGYKEVKKDLIIKLPKYSLFELENGRKRMLASAGELQKGNELALPSKYVNFLYLAS HYEKLKGSPEDNEQKQLFVEQHKHYLDEIIEQISEFSKRVILADANLDKVLSAYNKHRDKPIREQAENIIHLF TLTNLGAPAAFKYFDTTIDRKQYTSTKEVLDATLIHQSITGLYETRIDLSQLGGD | 451. |

TABLE 3-continued

| | SEQ ID NO: |
|---|---|
| KTEVQTGRFSKESILPKRNSDKLIARKKDWDPKKYGGFNSPTVAYSVLVVAKVEKGKSKKLKSVKELLGITI<br>MERSSFEKNPIDFLEAKGYKEVKKDLIIKLPKYSLFELENGRKRMLASAGELQKGNELALPSKYVNFLYLAS<br>HYEKLKGSPEDNEQKQLFVEQHKHYLDEIIEQISEFSKRVILADANLDKVLSAYNKHRDKPIREQAENIIHLF<br>TLTNLGAPAAFKYFDTTIDRKQYTSTKEVLDATLIHQSITGLYETRIDLSQLGGD | 452. |
| KTEVQTGGFSKESILPKRNSDKLIARKKDWDPKKYGGFYSPTVAYSVLVVAKVEKGKSKKLKSVKELLGITI<br>MERSSFEKNPIDFLEAKGYKEVKKDLIIKLPKYSLFELENGRKRMLASAGELQKGNELALPSKYVNFLYLAS<br>HYEKLKGSPEDNEQKQLFVEQHKHYLDEIIEQISEFSKRVILADANLDKVLSAYNKHRDKPIHEQAENIIHL<br>FTLTNLGAPAAFKYFDTTIDRKQYTSTKEVLDATLIHQSITGLYETRIDLSQLGGD | 453. |
| KTEVQTGGFSKESILPKRNSDKLIARKKDWDPKKYGGFYSPTVAYSVLVVAKVEKGKSKKLKSVKELLGITI<br>MERSSFEKNPIDFLEAKGYKEVKKDLIIKLPKYSLFELENGRKRMLASAGELQKGNELALPSKYVNFLYLAS<br>HYEKLKGSPEDNEQKQLFVEQHKHYLDEIIEQISEFSKRVILADANLDKVLSAYNKHRDKPIREQAENIIHLF<br>TLTNLGAPAAFKYFDTTIDRKQYTSTKEVLDATLIHQSITGLYETRIDLSQLGGD | 454. |
| KTEVQTGGFSKESILPKRNSDKLIARKKDWDPKKYGGFYSPTVAYSVLVVAKVEKGKSKKLKSVKELLGITI<br>MERSSFEKNPIDFLEAKGYKEVKKDLIIKLPKYSLFELENGRKRMLASAGELQKGNELALPSKYVNFLYLAS<br>HYEKLKGSPEDNEQKQLFVEQHKHYLDEIIEQISEFSKRVILADANLDKVLSAYNKHRNKPIREQAENIIHL<br>FTLTNLGAPAAFKYFDTMIDRKQYTSTKEVLDATLIHQSITGLYETRIDLSQLVGD | 455. |
| KTEVQTGGFSKESILPKRNSDKLIARKKDWDPKKYGGFYSPTVAYSVLVVAKVEKGKSRKLKSVKELLGITI<br>MERSSFEKNPIDFLEAKGYKEVKKDLIIKLPKYSLFELENGRKRMLASAGELQKGNELALPSKYVNFLYLAS<br>HYEKLKGSPEDNEQKQLFVEQHKHYLDEIIEQISEFSKRVILADANLDKVLSAYNKHRDKPIREQAENIIHLF<br>TLTNLGAPAAFKYFDTTIDRKQYTSTKEVLDATLIHQSITGLYETRIDLSQLGGD | 456. |
| KTEVQTGGFSKESILPKRNSDKLIARKKDWDPKKYGGFYSPTVAYSVLVVAKVEKGKSKKLKSVKELLGITI<br>MERSSFEKNPIDFLEAKGYKEVKKDLIIKLPKYSLFELENGRKRMLASAGELQKGNELALPSKYVNFLYLAS<br>HYEKLKGSPEDNEQKQLFVEQHKHYLDEIIEQISEFSKRVILADANLDKVLSAYNKHRDKPIREQAENIIHLF<br>TLTNLGAPAAFKYFDTTIDRKQYTSTKEVLDATLIHQSITGLYETRIDLSLLGGD | 457. |
| KTEVQTGGFSKESILPNRNSDKLIARKKDWDPKKYGGFDSPTVAYSVLVVAKVEKGKSKKLKSVKELLGITI<br>MERSSFEKKPIDFLEAKGYKEVKKDLIIKLPKYSLFELENGRKRMLASAGELQKGNELALPSKYVNFLYLAS<br>HYEKLKGSPEDNEQKQLFVEQHKHYLDEIIEQISEFSKRVILADANLDKVLSAYNKHRDKPIREQAENIIHLF<br>TLTNLGAPAAFKYFDTTIDRKQYRSTKEVLDATLIHQSITGLYETRIDLSQLGGD | 458. |
| KTEVQTGGFSKESILPKRNSDKLIARKKDWDPKKYGGFYSPTVAYSVLVVAKVKKGKSKKLKSVKELLGITI<br>MERSSFEKNPIDFLEAKGYKEVKKDLIIKLPKYSLFELENGRKRMLASAGELQKGNELALPSKYVNFLYLAS<br>HYEKLKGSPEDNEQKQLFVEQHKHYLDEIIEQISEFSKRVILADANLDKVLSAYNKHRDKPIREQAENIIHLF<br>TLTNLGAPAAFKYFDTTIDRKQYTSTKEVLDATLIHQSITGLYETRIDLSQLGGD | 459. |
| KTEVQTGGFSKESILPKRNSDKLIARKKDWDPKKYGGFNSPTVAYSVLVVAKVEKGKSKKLKSVKELLGITI<br>MERSSFEKNPIDFLEAKGYKEVKKDLIIKLPKYSLFELENGRKRMLASAGELQKGNELALPSKYVNFLYLAS<br>HYEKLKGSPEDNEQKQLFVEQHKHYLDEIIEQISEFSKRVILADANLDKVLSAYNKHRDKPIREQAENIIHLF<br>TLTNLGAPAAFKYFDTTIDRKQYTSTKEVLDATLIHQSITGLYETRIDLSQLGGD | 460. |
| ETEVQTGGFSKESILPKRNSDKLIARKKDWDPKKYGGFDSPTVAFSVLVVAKVEKGKSKKLKSVKELLGITI<br>MERSFFEKNPIDFLEAKGYKEVKKDLIIKLPKYSLFELENGRKRMLASAGELQKGNELALPSKYVNFLYLAS<br>HYEKLKGSPEDNEQKQLFVEQHKHYLDEIIEQISEFSKRVILADANLDKVLSAYNKHRDKPIREQAENIIHLF<br>TLTNLGAPAAFKYFDTTIDRKQYTSTKEVLDATLIHQSITGLYETRIDLSQLGGD | 461. |
| KTEVQTGGFSKESILPKRNSDKLIARKKDWDPKKYGGFYSPTVAYSVLVVAKVEKGKSKKLKSVKDLLGITI<br>MERSSFEKNPIDFLEAKGYKEVKKDLIIKLPKYSLFELENGRKRMLASAGELQKGNELALPSKYVNFLYLAS<br>HYEKLKGSPEDNEQKQLFVEQHKHYLDEIIEQISEFSKRVILVDANLDKVLSAYNKHRDKPIREQAENIIHLF<br>TLTNLGAPAAFKYFDTTIDRKQYTSTKEVLDATLIHQSITGLYETRIDLSQLGGD | 462. |
| KTEVQTGGFSKESILPKRNSDKLIARKKDWDPKKYGGFDSPTVAYSVLVVAKVEKGKSKKLKSVKELLGIT<br>NMERSSFEKNPIDFLEAKGYKEVKKDLIIKLPKYSLFELENGRKRMLASAEELQKGNELALPSKYVNFLYLA<br>SHYEKLKGSPEDNEQKQLFVEQHKHYLDEIIEQISEFSKRVILADANLDKVLSAYNKHRDKPIREQAENIIHL<br>FTLTNLGAPAAFKYFDATIDRKQYRSTKEVLDATLIHQSITGLYETRIDLSQLGGD | 463. |
| KTEVQTGGFSKESILPKRNSDKLIARKKDWDPKKYGGFDSPTVAYSVLVVAKVEKGKSKKLKSVKELLGITI<br>MERSSFEKNPIDFLEAKGYKEVKKDLIIKLPKYSLFELENGRKRMLASAGELQKGNELALPSKYVNFLYLAS<br>HYEKLKGSPEDNEQKQLFVEQHKHYLDEIIEQISEFSKRVILADANLDKVLSAYNKHRDKPIREQAENIIHLF<br>TLTNLGAPAAFKYFDTTIYRKQYTSTKEVLDATLIHQSITGLYETRIDLSQLGGD | 464. |
| KTEVQTGGFSKESILPKRNSDKLIARKKDWDPKKYGGFYSPTVAYSVLVVANVEKGKSKKLKSVKELLGITI<br>MERSSFEKNPIDFLEAKGYKEVKKDLIIKLPKYSLFELENGRKRMLASAGELQKGNELALPSKYVNFLYLAS<br>HYEKLKGSPEDNEQKQLFVEQHKHYLDEIIEQISEFSKRVILADANLDKVLSAYNKHRDKPIREQAENIIHLF<br>TLTDLGAPAAFKYFDTTIDRKQYTSTKEVLDATLIHQSITGLYETRIDLSQLGGD | 465. |
| Selected mutant clones for VRER variant, sequence from K1097-D1368 | |
| KTEVQTGGFSKESILPKRNSDKLIARKKDWDPKKYGGFNSPTVAYSVLVVAKVEKGKSKKLKSVKELLGITI<br>MERSSFEKNPIDFLEAKGYKEVKKDLIIKLPKYSLFELENGRKRMLASARELQKGNELALPSKYVNFLYLAS<br>HYEKLKGSPEDNEQKQFFVEQHKHYLDEIIEQISEFSKRVILADANLDKVLSAYNKHRDKPIREQAENIIHL<br>FTLTNLGAPAAFKYFDTTIDRKEYRSTKEVLDATLIHQSITGLYETRIDLSQLGGD | 466. |

TABLE 3-continued

| | SEQ ID NO: |
|---|---|
| KTEMQTGGFSKESVLPKRNSDKLIARKKDWDPKKYGGFNSPTVAYSVLVVAKVEKGKSKRLKSVKELLGI TIMERSSFEKNPIDFLEAKGYKEVKKDLIIKLPKYSLFELENGRKRMLASAGVLQKGNELALPSKYVNFLYLA SHYEKLKGSPDDNEQKRLFVEQHKHYLDEIIEQISEFSKRVILADANRDKVLSAYNKHRDKPIREQAENIIH LFTLTNLGAPAAFKYFDTTIDRKEYRSTKEVLDATLIHQSITGLYETRIDLSQLGGD | 467. |
| KTEVQTGGFSKESILPKRNSDKLIARKKDWDPKKYGGFYSPTVAYSVLVVAKVEKGKSKKLKSVKELLGITI MERSSFEENPIDFLEAKGYKEVKKDLIIKLPKYSLFELENGRKRMLASAGELQKGNELALPSKYVNFLYLAS HYEKLKGSPKDNEQKQLFVEKHKHYLDEIIEQISEFSKRVILADANLDKVLSAYNKHRDKPIREQAENIIHLF TLTNLGAPAAFKYFDTTIDRKEYRSTKEVLDATLIHQSITGLYETRIDLSQLGGD | 468. |
| KTEVQTGGFSKESILPKRNSDKLIARKKDWDPKKYGGFNSPTVAYSVLVVANVEKGKSKKLKSVKELLGITI MERSSYEKNPIDFLEAKGYKEVKKDLIIKLPKYSLFELENGRKRMLASAGVLQKGNELALPSKYVNFLYLAS HYEKLKGSPEDNEQKQLFVEQHKHYLDEIIEQISEFSKRVILADANLDKVLSAYNKHRDKPIREQAENIIHLF TLTNLGAPAAFKYFDTTIDRKEYRSTKEVLDATLIHQSITGLYETRIDLSQLGGD | 469. |
| KTEVQTGGFSKESILPKRNSDKLIARKKDWDPKKYGGFVSPTVAYSVLVVAKVEKGKSKKLKSVKELLGITI MERSSFEKNPIDFLEAKGYKEVKKDLIIKLPKYSLFELENGRKRMLASAGELQKGNELALPSKYVNFLYLAS HYEKLKGSPEDNEQKQLFVEQHKHYLDEIIEQISEFSKRVILADANLDKVLSAYNKHRDKPIREQAENIIHLF TLTNLGAPAAFKYFDTTIDRKQYRSTKEVLDATLIHQSFTGLYETRIDLSQLGGD | 470. |
| KTEVQTGGFSKESILPKRNSDKLIARKKDWDPKKYGGFDSPTVAYSVLVVAKVEKGKSKKLKSVKELLGITI MERSSFEKNPIDFLEAKGYKEVKKDLIIKLPKYSLFELENGRKRMLASARELQKGNELALPSKYVNFLYLAS HYEKLKGSPEDNEQKQLFVEQHKHYLDEIIEQISEFSKRVILADANLDKVLSAYNKHRDKPIREQAENIIHLF TLTNLGAPAAFKYFDTTIDRKEYRSTKEVLDATLIHQSITGLYETRIDLSQLGGD | 471. |
| KTEVQTGGFSKESILPKRNSDKLIARKKDWDPKKYGGFNSPTVAYSVLVVAKDEKGKSKKLKSVKELLGITI MERSSFEKNPIDFLEAKGYKEVKKDLIIKLPKYSLFELENGRKRMLASAGELQKGNELALPSKYVNFLYLAS HYEKLKGSPEDNEQKQLFVEQHKHYLDEIIEQISEFSKRVILADANLDKVLSAYNKHRDKPICEQAENIIHLF TLTKLGAPAAFKYFDTTIDRKEYRSTKEVLDATLIHQSITGLYETRIDLSQLGGD | 472. |
| KTEVQTGGFSKESILPKRNSDKVIARKKDWDPKKYGGFDSPTVAYSVLVVAKVEKGKSKKLKSVKELLGITI MERSSFEKNPIDFLEAKGYKEVKKDLIIKLPKYSLFELENGRKRMLASAGELQKGNELALPSKYVNFLYLAS HYEKLKGSPEDNEQKQLFVEQHKHYLDEIIEQISEFSKRVILADANLDKVLSAYNKHRDKPIREQAENIIHLF TLTNLGAPAAFKYFDTTIDRKEYRSTKEVLDATLIHQSITGLYETRIDLSQLGGD | 473. |
| KTEVQTGGFSKESILPKRNSDKLIARKKDWDPKKYGGFYSPIVAYSVLVVAKVEKGKSKKLKSVKELLGITI MERSSFEKNPIDFLEAKGYKEVKKDLIIKLPKYSLFELENGRKRMLASAGVLQKGNELALPSKYVNFLYLAS HYEKLKGSPEDNEQKQLFVEQHKHYLDEIIEQISEFSKRVILADANLDKVLSAYNKHRDKPIREQAENIIHLF TLTNLGAPAAFKYFDTTIDRKEYRSTKEVLDATLIHQSITGLYETRIDLSQLGGD | 474. |
| KTEVQTGGFSKESILPKRNSDKLIARKKDWDPKKYGGFYSPTVAYSVLVVAKVEKGKSKKLKSVKELLGITI MERSSFEKNPIDFLEAKGYKEIKKDLIIKLPKYSLFELENGRKRMLASAGELQKGNELALPSKYVNFLYLASH YEKLKGSPEDNEQKQLFVEQHKHYLDEIIEQISEFSKRVILADANLDKVLSAYNKHRDKTIREQAENTIHLF TLTNLGAPAAFKYFDTTIDRKEYRSTKEVLDATLIHQSITGLYETRIDLSQLGGD | 475. |
| KTEVQTGGFSKESILPKRNSDKLIARKKDWDPKKYGGFYSPTVAYSVLVVAKVEKGKSKKLKSVKELLGITI MERSSFEKNPIDFLEAKGYKEVKKDLIIKLPKYSLFELENGRKRMLASAGELQKGNELALPSKYVNFLYLAS HYEKLKGSPEDNEQKQLFVEQHKHYLDEIIEQISEFSKRVILADANLDKVLSAYNKHRDKPIREQAENIIHLF TLTNLGAPAAFKYFDTTIDRKEYRSTKEVLDATLIHHSITGLYETRIDLSQLGGD | 476. |
| KTEVQTGGFSKESILPKRNSDKLIARKKDWDPKKYGGFYSPTVAYSVLVVAKVEKGKSKKLKSVKELLGITI MERSSFEKNPIDFLEAKGYKEVKKDLIIKLPKYSLFELENGRKRMLASAGELQKGNELALPSKYVNFLYLAS HYEKLKGSPEDNEQKQLFVEQHKHYLDEIIEQISEFSKRVILADGNLDKVLSAYNKHRDKPIREQAENIIHL FTLTNLGAPAAFKYFDTTIDRKEYRSTKEVLDATLIHQSITGLYETRIDLSQLGGD | 477. |
| KTEVQTGGFSKESILPKRNSDKLIARKKDWDPKKYGGFDSPTVAYSVLVVAKVEKGKSKKLKSVKELLGITI MERSSFEKNPIDFLEAKGYKEVKKDLLIKLPKYNLFELENGRKRMLASAGELQKGNELALPSKYVNFLYLAS HYEKLKGSPEDNEQKQLFVEQHKHYLDEIIEQISEFSKRVILADANLDKVLSAYNKHRDKPIREQAENIIHLF TLTNLGAPAAFKYFDTTIDRKQYRSTKEVLDATLIHQSITGLYETRIDLSQLGGD | 478. |
| KTEVQTGGFSKESILPKRNSDKLIARKKDWDPKKYGGFNSPTVAYSVLVVAKVEKGKSKKLKSVKELLGITI MERSSFEKNPIDFLEAKGYKEVKKDLIIKLPKYSLFELENGRKRMLASAGELQKGNELALPSKYVNFLYLAS HYEKLKGSPDYNEQKQLFVEQHKHYLDEIIEQISEFSKRVILADANLDKVLSAYNKHRDKPIREQAENIIHLF TLTNLGAPAAFKYFDTTIDRKEYRSTKEVLDATLIHQSITGLYETRIDLSQLGGD | 479. |
| KTEVQTGGFSKESILPKRNSDKLIARKKDWDPKKYGGFDSPKVAYSVLVVAKVEKGKSKKLKSVKELLGITI MERSSFEKNPIDFLEAKGYKEVKKDLIIKLPKYSLFELENGRKRMLASAGELQKGNELALPSKYVNFLYLAS HYEKLKGSPEDNEQKQLFVEQHKHYLDEIIEQISEFSKRVILADANLDKVLSAYNKHRDKPIREQAENIIHLF TLTNLGAPAAFKYFDTTIDRKQYRSTKEVLDATLIHQSITGLYETRIDMSQLGGD | 480. |
| KTEVQTGGFSKESILPKRNSDKLIARKKDWDPKKYGGFYSPTVAYSVLVVAKVEKGKSKKLKSVKELLGITI MERSSFEKNPIDFLEAKGYKEVKKDLIIKLPKYSLFELENGRKRMLASAGELQKGNELALPSKYVNFLYLAS HYEKLKGSPEDNEQKQLFVEQHKHYLDEIIEQISEFSKRVILADANLDKVLIAYNKHRDKPIREQAENIIHLF TLTNLGAPAAFKYFDTTIDRKEYRSTKEVLDATLIHQSITGLYETRIDLSQLGGD | 481. |

TABLE 3-continued

| | SEQ ID NO: |
|---|---|
| KTEEQTGGFSKESIHPKRNSDKLIARKKDWDPKKYGGFHSPTVAYSVLVVAKVEKGKSKKLKSVKELLGITI MERSSFEKNPIDFLEAKGYKEVKKDLIIKLPKYSLFELENGRKRMLASAGELQKGNELALPSKYVNFLYLAS HYEKLKGSPEDNEQKQLFVEQHKHYLDEIIEQISEFSKRVILADANLDKVLSAYNMHRDKPIREQAENIIHL FTLTNLGAPAAFKYFDTTIDRKEYRSTKEVLDATLIHQSITGLYETRIDLSQLEGD | 482. |
| KTEVQTGGFSKESILPKRNSDKLIARKKDWDPKKYGGFYSPTVAYSVLVVAKVEKGKSKKLKSVKELLGITI MERSSFEKNPIDFLEAKGYKEVKKDLIIKLPKYSLFELENGRKRMLASAGELQKGNELALPSKYVNFLYLAS HYEKLKGSPEDNEQMQLFVEQHKHYLDEIIEQISEFSKRVILADANLDKVLSAYNKHRDKPIREQAENIIHL FTLTNLGAPAAFKYFDTTIDRKEYRSTKEVLDATLIHQSITGLYETRIDLSQLGGD | 483. |
| KTEVQTGRFSKESILPKRNSDKLIARKKDWDPKKYGGFVSPTVAYSVLVVAKVEKGKSKKLKSVKELLGITI MERSSFEKNPIDFLEAKGYKEVKKDLIIKLPKYSLFELENGRKRMLASAGELQKGNELALPSKYVNFLYLAS HYEKLKGSPEDNEQKQLFVEQHKHYLDEIIEQISEFSKRVILADANLDKVLSAYNKHRDKPIREQAENIIHLF TLTNLGAPAAFKYFDTTIDRKEYRSTKEVLDATLIHQSITGLYETRIDLSQLGGD | 484. |
| KTEVQTGGFSKESILPKRNSDKLIARKKDWDPKKYGGFDSPTVAYSVLVVAKVEKGKSKKVKSVKELLGITI MERSSFEKNPIDFLEAKGYKEVKKDLIIKLPKYSLFELENGRKRMLASAGVLQKGNELALPSKYVNFLYLAS HYEKLKGSPEDNEQKQLFVEQHKHYLDEIIEQISEFSKRVILADANLDKVLSAYNKHRDKPIREQAENIIHLF TLTNLGAPAAFKYFDTTIDRKEYRSTKEVLDATLIHQSITGLYETRIDLSQLGGD | 485. |
| KTEVQTGGFSKESILPKRNSDKLIARKKDWDPKKYGGFYSPTVAYSVLVVAKVEKGKSKKLKSVKELLGITI MERSSFEKNPIDFLEAKGYKEVKKDLIIKLPKYSLFELENGRKRMLASAGELQKGNELALPSKYVNFLYLAS HPEKLKGSPEDNEQKQLFVEQHKHYLDEIIEQISEFSKRVILADANLDKVLSAYNKHRDKPIREQAENIIHLF TLTNLGAPAAFKYFDTMIDRKEYRSTKEVLDATLIHQSITGLYETRIDLSQLGGD | 486. |
| KTEVQTGGFSKESILPKRNSDKLIARKKDWDPKKYGGFVSPTVAYSVLVVAKVEKGKSKKLKSVKELLGITI MERSSFEKNPIDFLEAKGYKEVKKDLIIKLPKYSLFELENGRKRMLASAGELQKGNELALPSKYVNFLYLAS HYEKLKGSPEDNEQKQLFVEQPKHYLDEIIEQISEFSKRVILADANLDKVLSAYNKHRDKPIREQAENIIHLF TLTNLGAPAAFKYFDTTIDRKEYRSTKEVLDATLIHQSITGLYETRIDLSQLGGD | 487. |
| KTEVQTGGFSKESILPKRNSDKLIARKKDWDPKKYGGFVSPTVAYSVLVVAKVEKGKSKKLKSVKELLGITI MERSSFEKNPIDFLEAKGYKEVKKDLIIKLPKYSLFELENGRKRMLASAGELQKGNEIALPSKYVNFLYLAS HYEKLKGSPEDNEQKQLFVEQHKHYLDEIIEQISEFSKRVILADANLDKVLSAYNKHRDKPIREQAENIIHLF TLTNLGAPAAFKYFDTKIDRKEYRSTKEVLDATLIHQSITGLYETRIDLSQLGGD | 488. |
| KTEVQTGGFSKESILPKRNSDKLIARKKDWDPKKYGGFYSPTVAYSVLVVAKVEKGKSKKLKSVKELLGITI MERSSFEKNPIDFLEAKGYKEVKKDLIIKLPKYSLFELENGRKRMLASAGELQKGNELALPSKYVNFLYLAS HYEKLKGSPEDNEQKQLFVEQHKHYLDEIIEQISEFSKRVILADANLDKVLSAYNKHRDKPIREQAENIIHLF TLTNLGAPAAFKYFDTTIDRKEYRSTKEVLDATLIHQSITGLYETRIDLSQLGGD | 489. |
| KTEVQTGGFSKESILPKRNSDKLIARKKDWDPKKYGGFDSPTVAYSVLVVAKVEKGKSKKLKSVKELLGITI MERSSFEKNPIDFLEAKGYKEVKKDLIIKLPKYSLFELENGRKRMLASAGVLQKGNELALPSKYVNFLYLAS HYEKLKGSPEDNEQKQLFVEQHKHYLDEIIEQISEFSKRVILADANLDKVLSAYNKHRDKPIREQAENIIHLF TLTNLGAPAAFKYFDTTIDRKEYRSTKEVLDATLIHQSITGLYETRIDLSQLGGD | 490. |
| KTEVQTGGFSKESILPKRNSDKLIARKKDWDPKKYGGFYSPTVAYSVLVVAKVEKGKSKKLKSVKELLGITI MERSSFEKNPIDFLEAKGYKEVKKDLIIKLPKYSLFELENGRKRMLASAGELQKGNELALPSKYVNFLYLAS HYEKLKGSPEDNEQKQLFVEQHKHYLDEIIEQISEFSKRVILADANLDKVLSAYNKHRDKPIREQAENIIHLF TLTNLGAPAAFKYFDTTIDRKEYRSTKEVLDATLIHQSITGLYETRIDLSQLGGD | 491. |
| KTEVQTGGFSKESILPKRNSDKLIARKKDWDPKKYGGFYSPTVAYSVLVVAKVEKGKSKKLKSVKELLGITI MERSSFEKNPIDFLEAKGYKEVKKDLIIKLPKYSLFELENGRKRMLASAGELQKGNELALPSKYVNFLYLAS HYEKLKGSPEDNEQKQLFVEQHKHYLDEIIEQISEFSKRVILADANLDKVLSAYNKHRDKPIREQAENIIHLF TLTNLGAPAAFKYFDTTIDRKEYRSTKEVLDATLIHQSITGLYETRIDLSQLGGD | 492. |
| KTEVQTGGFSKESILPKRNSDKLIARKKDWDPKKYGGFDSPTVAYSVLVVAKVEKGKSKKLKSVKELLGITI MERSSFEKNPFDFLEAKGYKEVKKDLIIKLPKYSLFELENGRKRMLASAGELQKGNELALPSKYVNFLYLAS HYEKLKGSPEDNEQKQLFVEQHKHYLDEIIEQISEFSKRVILADPNLDKVLSAYNKHRDKPIREQAENIIHLF TLTNLGAPAAFKYFDTTIDRKEYRSTKEVLDATLIHQSITGLYETRIDLSQLGGD | 493. |
| KTEVQTGGFSKESILPKRNSDKLIARKKDWDPKKYGGFLSPTVAYSVLVVAKVEKGKSKKLKSVKELLGITI MERSSFEKNPIDFLEAKGYKEVKKDLIIKLPKYSLFELENGRKRMLASAGELQKGNELALPSKYVNFLYLAS HYEKLKGSPEDNEQKQLFVEQHKHYLDEIIEQISEFSKRVILADANLDKVLSAYNKHRDKPIREQAENIIHLF TLTNLGAPAAFKYFDTTIDRKEYRSTKEVLDATLIHQSITGLYETRIDLSQLGGD | 494. |
| KTEVQTGGFSKESILPKRNSDKLIARKKDWDPKKYGGFDSPTVAYSVLVVAKVEKGKSKKLKSVKELLGITI MERSSFEKNPIDFLEAKGYKEVKKDLIIKLPKYSLFELENGRKRMLASAGELQKGNELALPSKYVNFLYLAS HYEKLKGSPEDNEQKQLFVEQHKHYLDEIIEQISEFSKRVILADANLDKVLSAYNKHRDKPIREQAENIIHLF TLTNLGAPAAFKYFDTTIDRKEYRSTKEVLDATLIHQSITGLYETRIDLSQLGGD | 495. |
| KTEVQTGGFSKESILPKRNSDKLIARKKDWDPKKYGGFYSPTVAYSVLVVAKVEKGKSKKLKSVIELLGITI MERSSFEKNPIDFLEAKGYKEVKKDLIIKLPKYSLFELENGRKRMLASAGELQKGNELALPSKYVNFLYLAS HYEKLKGSPEDNEQKQLFVEQHKHYLDEIIEQISEFSKRVILADANLDKVLSAYNKHRDKPIREQAENIIHLF TLTNLGAPAAFKYFDTTIDRKEYRSTKEVLDATLIHQSITGLYETRIDLSQLGGD | 496. |

TABLE 3-continued

| | SEQ ID NO: |
|---|---|
| KTEVQTGGFSKESILPKRNSDKLIARKKDWDPKKYGGFYSPTVAYSVLVVAKVEKGKSKKLKSVKELLGITI MERSSFEKNPIDFLEAKGYKEVKKDLIIKLPKYSLFELENGRKRMLASAGELQKGNELALPSKYVNFLYLAS HYEKLKGSPEDNEQKQLFVEQHKHYLDEIIEQISEFSKRVILADANLDKVLSAYNKHRDKPIREQAENIIHLF TLTNLGAPAAFKYFDTTIDRKEYRSTKEVLDATLIHQSITGLYETRIDLSQLGGD | 497. |
| KTEVQTGGFSKESILPKRNSDKLIARKKDWDPKKYGGFDSPTVAYSVLVVAKVEKGKTKKLKSVKELLGITI MERSSFEKNPIDFLEAKGYKEVIKDFIIKLPKYSLFELENGRKRMLASAGELQKGNELALPSKYVNFLYLASH YEKLKGSPEDNEQKQLFVEQHKHYLDEIIEQISEFSKRVILADANLDKVLSAYNKHRDKPIREQAENIIHLFT LTNLGAPAAFKYFDTTIDRKQYRSPKEVLDATLIHQSITGLYETRIDLSQLGGD | 498. |
| KTEVQTGGFSKESILPKRNSDKLIARKKDWDPKKYGGFYSPTVAYSVLVVAKVEKGKSKKLKSVKELLGITI MERSSFEKNPIDFLEAKGYKEVKKDLIIKLPKYSLFELENGRKRMLASAGELQKGNELALPSKYVNFLYLAS HYEKLKGSPEDNEQKQLFVEQHKHYLDEIIEQISEFSKRVILADANLDKVLSAYNKHRDKPIREQAENIIHLF TLTNLGAPAAFKYFDTTIDRKEYRSTKEVLDATLIHQSITGLYETRIDLSQLGGD | 499. |
| KTEVQTGGFSKESILPKRNSDKLIARKKDWDPKKYGGFYSPTVAYSVPVVAKVEKGKSKKLKSVKELLGITI MERSSFEKNPIDFLEAKGYKEVKKDLIIKLPKYSLFELESGRKRMLASAGELQKGNELALPSKYVNFLYLAS HYEKLKGSPEDNEQKQLFVEQHKHYLDEIIEQISEFSKRVILADANLDKVLSAYNKHRDKPIREQAENIIHLF TLTNLGAPAAFKYFDTTIDRKEYRSTKEVLDATLIHQSITGLYETRIDLSQLGGD | 500. |
| KTEVQTGGFSKESILPKRNSDKLIARKKDWDPKKYGGFYSPTVAYSVLVVAKVEKGKSKKLKSVKELLGITI MERSSFEKNPIDFLEAKGYKEVNKDLIIKLPKYSLFELENGRKRMLASAGELQKGNELALPSKYVNFLYLAS HYEKLKGSPEDNEQKQLFVEQHKHYLDEIIEQISEFSKRVILADANLDKVLSAYNKHRDKPIREQAENIIHLF TLTNLGAPAAFKYFDTTIDRKTYRSTKEVLDATLIHQSITGLYETRIDLSQLGGD | 501. |
| KTEVQTGGFSKESILPKRNSDKLIARKKDWDPKKYGGFYSPTVAYSVLVVAKVEKGKSKKLKSVKELLGITI MERSSFEKNPIDFLEAKGYKEVKKDLIIKLPKYSLFELENGRKRMLASAGELQKGNELALPSKYVNFLYLAS HYEKLKGSPEDNEQKQLFVEQHKHYLDEIIEQISEFSKRVILADANLDKVLSAYNKHRDKPIHEQAENIIHL FTLTNLGAPAAFKYFDTTIDRKTYRSTKEVLDATLIHQSITGLYETRIDLSQLGGD | 502. |
| KTEVQTGGFSKESILPKRNSDKLIARKKDWDPKKYGGFDSPTVAYSVLVVAKVEKGKSKKLKSVKELLGITI MERSSFEKNPIDFLEAKGYKEVKKDLMIKLPKYSLFELKNGRKRMLASAGELQKGNELALPSKYVNFLYLA SHYEKLKGSPEDNEQKQLFVEQHKHYLDEIIEQISEFSKRVILADANLDKVLSAYNKHRDKPIREQAENIIHL FTLTNLGAPAAFKYFDTTIDRKTYRSTKEVLDATLIHHSITGLYETRIDLSQLGGD | 503. |
| KTEVQTGGFSKESILPKRNSDKLIARKKDWDPKKYGGFDSPTVAYSVLVVAKVEKGKSKKLKSVKELLGITI MERSSFEKNPIDFLEAKGYKEVKKDLIIKLPKYSLFELENGRKRMLASARELQKGNELALPSKYVNFLYLAS HYEKLKGSPEDNEQKQLFVEQHKHYLDEIIEQISEFSKRVILADANLDKVLSAYNKHRDKPIREQAENIIHLF TLTNLGAPAAFKYFDTTIDRKTYRSTKEVLDATLIHQSITGLYETRIDLSQLGGD | 504. |
| KTEVQTGGFSKESILPKRNSDKLIARKKDWDPKKYGGLYSPTVAYSVLVVAKVEKGKSKKLKSVKELLGITI MERSSFEKNPIDFLEAKGYKEVKRDLIIKLPKYSLFELKNGRKRMLASAGELQKGNELALPSKYVNFLYLAS HYEKLKGSPEDNEQKQLFVEQHKHYLDEIIEQISEFSKRVILADANLDKVLSAYNKHRDKPIREQAENIIHLF TLTNLGAPAAFKYFDTTIDRKTYRSTKEVVDATLIHQSITGLYETRIDLSQLGGD | 505. |
| KTEVQTGGFSKESIHPKRNSDKLIARKKDWDPKKYGGFNSPTVAYSVLVVAKVEKGKSKKLKSVKELLGITI MERSSFEKNPIDFLEAKGYKEVKKDLIITLPKYSLFELENGRKRMLASAGELQKGNELALPSKYVNFLYLAS HYEKLKGSPEDNEQKQLFVEQHKHYLDEIIEQISEFSKRVILADSNLDKVLSAYNKHRDKPIREQAENIIHLF TLTNLGAPAAFKYFDTTIDRKTYRSTKEVLDATLIHQSITGLYETRIDLSQLGGD | 506. |
| KTEVQTGGFSKESILPKGNSDKLIARKKDWDPKKYGGFNSPTVAYSVLVVAKVEKGKSKKLKSVKELLGITI MERSSFEKNPIDFLEAKGYKEVKKDLIIKLPKYSLFELENGRKRMLASAGELQKGNELALPSKYVNFLYLAS HYEKLKGSPEDNEQKQLFVEQHKHYLDEIIEQISEFSKRVILADANLDKVLSAYNKHRDKPIREQAENIIHLF TLTNLGAPAAFKYFDTTIDRKTYRSTKEVLDATLIHQSITGLYETRIDLSQLGGD | 507. |
| KTEVQTGGFSKESILPKRNSDKLIARKKDWDPKKYGGFDSPTVAYSVLVVAKVEKGKSKKLKSVKDLLGITI MERSSFEKNPIDFLEAKGYKEVKKDLMIKLPKYSLFELENGRKRMLASARELQKGNELALPSKYVNFLYLA SHYEKLKGSPEDNEQKQLFVEQHKHYLDEIIEQISEFSKRVILADANLDKVLSAYNKHRDKPIREQAENIVH LFTLTNLGAPAAFKYFDTTIDRKTYRSTKEVLDATLIHQSITGLYETRIDLSQLGGD | 508. |
| KTEVQTGGFSKESILPKRNSDKLIARKKDWDPKKYGGFNSPTVAYSVLVVAKVEKGKSKKLKSVKELLGITI MERSSFEKNPIDFLEAKGYKEIKKDLIIKLPKYSLFELENGRKRMLASAGELQKGNELALPSKYVNFLYLASH YEKLKGSPEDNEQKQLFVEQHKHYLDEIIEQISEFSKRVILADVNLDKVLSAYNKHRDKPIREQAENIIHLFT LTNLGAPAAFKYFDTTIDRKTYRSTKEVLDATLIHQSITGLYETRIDLSQLGGD | 509. |
| KTEVQTGGFSKESIHPKRNSDKLIARKKDWDPKKYGGFDSPTVAYSVLVVAKVEKGKSKKLKSVKELLGITI MERSSFEKNPIDFLEAKGYKEVKKDLIIKLPKYSLFELENGRKRMLASARELQKGNELALPSKYVNFLYLAS HYEKLKGSPEDNEQKQLFVEQHKHYLDEIIEQISEFSKRVILADANLDKVLSAYNKDRDKPIREQAENIIHLF TLTNLGAPAAFKYFDTTIDRKTYRSTKEVLDATLIHQSITGLYETRIDLSQLGGD | 510. |

Example 2

Engineering the PAM Specificity of *Staphylococcus aureus* Cas9

Because we knew what residues of *Streptococcus pyogenes* Cas9 (SpCas9) were important for PAM recognition (R1333 and R1335), we generated an alignment of Cas9 orthologues to look for homologous residues in the PAM-interacting domain (PI domain) of *Staphylococcus aureus* Cas9 (SaCas9) (see FIG. 6). We and others have previously shown that the PAM of SaCas9 is NNGRRT (SEQ ID NO:46) (where N is any nucleotide, and R is an A or G). The preference for a G at the $3^{rd}$ position of the PAM appeared to be the most strict requirement based on our data, so we hypothesized that positively charged residues like lysine (K) or arginine (R) might be mediating that interaction. As shown in FIG. 6, there are a number of candidate residues in SaCas9 in the homologous region to R1333 and R1335 of SpCas9, including K1101, R1012, R1015, K1018, and K1023.

We generated alanine (A) and glutamine (Q) substitutions at these five positions to determine if the mutant clones could still cleave a site containing the canonical NNGRRT PAM (SEQ ID NO:46), or possibly cleave the previously non-targetable PAM of NNARRT (SEQ ID NO:43) (FIG. 7). We utilized our bacterial assay (described in the previous patent application), where activity of Cas9 can be visualized by survival of bacterial colonies when plated under a selective condition. The relative activity of Cas9 can be quantified by calculating the ratio of bacterial colonies growing on the selective versus the non-selective media. In FIG. 7, we show that only the R1015A and R1015Q mutations affect the ability of SaCas9 to recognize a canonical NNGAGT (SEQ ID NO:5) PAM, while no mutations enable targeting of NNARRT (SEQ ID NO:43) PAMs (NNAAGT (SEQ ID NO:41) or NNAGGT (SEQ ID NO:42)). These results suggested to us that R1015 plays a role in PAM recognition by SaCas9.

We then selected randomly mutagenized either wild-type SaCas9, or the R1015Q variant and selected for altered PAM specificity clones against sites containing NNAAGT (SEQ ID NO:41) or NNAGGT (SEQ ID NO:42) PAMs (as previously described for SpCas9). We identified, re-screened, and sequenced a number of mutant clones that could target these PAMs, with their amino acid sequences shown in FIG. 8 (and Table 6). In summary of these sequences, a number of changes appear to be very important for altering SaCas9 specificity (R1015Q, R1015H, E782K), while many other mutations may also contribute (N968K, E735K, K929R, A1021T, K1044N).

After identifying the positions and mutations essential for altering the PAM specificity of SaCas9 to NNARRT (SEQ ID NO:43), we assessed the contributions of the most abundant mutations to the specificity change by making single, double, and triple mutants combinations (Table 5). When testing these mutations against various PAMs in our positive selection (as previously described), we observed that a number of mutations allowed activity on both a canonical NNGAGT (SEQ ID NO:5) and non-canonical NNAAGT (SEQ ID NO:41) or NNAGGT (SEQ ID NO:42) PAMs, whereas the wild-type SaCas9 enzyme had very low activity on the non-canonical PAMs. Specifically, it appeared as though the triple mutations enabled a relaxed specificity at the third position of the PAM (KKQ, KKH, GKQ, GKH—named based on mutations to positions E782/N968/R1015), leading to a consensus PAM motif of NNRRRT (SEQ ID NO:45) versus the canonical NNGRRT (SEQ ID NO:46). This relaxation of the PAM requirement theoretically doubles the targeting range of SpCas9. Henceforth, variants will be named based on their identities at positions 782, 968, and 1015. For example, E782K/N968K/R1015H would be named the SaCas9 KKH variant.

TABLE 5

SaCas9 mutant activity in the bacterial screen

| mutation(s) | | | NNGAGT (SEQ ID NO: 5) | NNAAGT (SEQ ID NO: 41) | NNAGGT (SEQ ID NO: 42) |
|---|---|---|---|---|---|
| E782 | N968 | R1015 | % activity | % activity | % activity |
|  |  |  | 100.0 | 21.4 | 15.7 |
|  |  | Q | 0.0 | 4.3 | 0.0 |
|  |  | H | 100.0 | 100.0 | 57.1 |
| K |  |  | 85.7 | 61.4 | 57.1 |
| G |  |  | 85.7 | 57.1 | 57.1 |
|  | K |  | 100.0 | 57.1 | 57.1 |
| K |  | Q | 85.7 | 92.9 | 85.7 |
| K |  | H | 100.0 | 100.0 | 85.7 |
| G |  | Q | 71.4 | 85.7 | 71.4 |
| G |  | H | 100.0 | 85.7 | 85.7 |
|  | K | Q | 85.7 | 85.7 | 85.7 |
|  | K | H | 85.7 | 92.9 | 92.9 |
| K | K |  | 71.4 | 71.4 | 71.4 |
| G | K |  | 85.7 | 71.4 | 71.4 |
| K | K | Q | 100.0 | 100.0 | 100.0 |
| K | K | H | 92.9 | 100.0 | 100.0 |
| G | K | Q | 92.9 | 92.9 | 100.0 |
| G | K | H | 100.0 | 100.0 | 100.0 |

We next assessed two of the triple mutants in the human cell EGFP disruption assay (as previously described) to determine whether the engineered variants could target non-canonical PAMs in a human cell context (FIG. 9). Variants capable of targeting sites within the EGFP gene containing non-canonical PAMs will disrupt the EGFP coding frame, leading to loss of signal. The results revealed that both the KKQ and KKH mutants retained similar activity to wild-type SaCas9 on canonical NNGRRT (SEQ ID NO:46) PAMs, but had much higher activity on NNARRT (SEQ ID NO:43) PAMs.

Overall, we've identified mutations in SaCas9 (KKQ or KKH variants) that appear to relax the preference of the wild-type enzyme at the third position of the PAM from a G to an R (A or G). This effectively relaxes the targeting of SaCas9 from an NNGRRT (SEQ ID NO:46) PAM constraint to an NNRRRT (SEQ ID NO:45) PAM.

Because we had successfully derived variants that could target NNARRT (SEQ ID NO:43) PAMs in human cells, we next asked the question of whether we could engineer variants with specificity for NNCRRT (SEQ ID NO:47) or NNTRRT (SEQ ID NO:48). To do so, we first mutated R1015 to E (in the case of specifying a C at the 3$^{rd}$ position of the PAM) and to L or M (in the case of specifying a T at the 3$^{rd}$ position of the PAM), and tested these against their expected PAMs in our bacterial positive selection assay (previously described) (FIG. 10). We observed that wild-type SaCas9 could inefficiently cleave a site containing an NNCAGT (SEQ ID NO:511) PAM, that an R1015E variant had slightly better activity on the same site, and that wild-type or any of the other directed mutations did not convey activity against other PAMs (FIG. 10). This suggested that as we saw with R1015Q, other mutations would be necessary to engineer SaCas9 variants that could target NNCRRT (SEQ ID NO:47) and NNTRRT (SEQ ID NO:48) PAMs.

For the SaCas9 evolved variants against NNARRT (SEQ ID NO:43) PAMs, the E782K and N968K mutations were necessary and essential along with the R1015(H/Q). To test whether these mutations would increase the activity of the R1015(E/L/M) variants against their expected PAM, we generated the KKE, KKL, and KKM variants. As shown in FIG. 11, the KKE, KKL, and KKM all had robust activity against their expected PAMs.

We were also curious as to whether the KKQ, KKH, KKE, KKL, or KKM variants had relaxed specificity against any nucleotide at the 3$^{rd}$ position of the PAM, so we interrogated a number of sites in our bacterial positive selection assay containing NNNRRT PAMs. As shown in FIG. 11, with a few exceptions nearly all of these variants can cleave all sites tested that contain NNNRRT PAMs. This indicated that they had a relaxed specificity at the 3$^{rd}$ position of the PAM as they can efficiently target NNNRRT sites. This is in contrast to the wild-type protein (ENR) that can only efficiently target the NNGAGT (SEQ ID NO:5) site, with very low activity on a few NNNRRT sites. In summary, the KKH (and other similar derivatives shown in FIG. 11) variant can target sites containing NNNRRT PAMs in bacteria, effectively quadrupling the targeting range of SaCas9.

Thus, the KKH variant (and some of the other variants in FIG. 6) can target NNNRRT PAMs in bacteria, effectively quadrupling the targeting range of SaCas9.

TABLE 6

| residues A652-G1053 of SaCas9 | SEQ ID NO: |
|---|---|
| Wild Type SaCas9 | |
| ATRGLMNLLRSYFRVNNLDVKVKSINGGFTSFLRRKWKFKKERNKGYKHHAEDALIIAN ADFIFKEWKKLDKAKKVMENQMFEEKQAESMPEIETEQEYKEIFITPHQIKHIKDFKDYK YSHRVDKKPNRELINDTLYSTRKDDKGNTLIVNNLNGLYDKDNDKLKKLINKSPEKLLMY HHDPQTYQKLKLIMEQYGDEKNPLYKYYEETGNYLTKYSKKDNGPVIKKIKYYGNKLNA HLDITDDYPNSRNKVVKLSLKPYRFDVYLDNGVYKFVTVKNLDVIKKENYYEVNSKCYEE AKKLKKISNQAEFIASFYNNDLIKINGELYRVIGVNNDLLNRIEVNMIDITYREYLENMND KRPPRIIKTIASKTQSIKKYSTDILGNLYEVKSKKHPQIIKKG | Aa 652-1053 of SEQ ID NO: 2. |
| Sequences of selected clones of SaCas9 variants | |
| ATRGLMNLLRSYFRVNNLDVKVKSINGGFTSFLRRKWKFKKERNKGYKHHAEDALIIAN ADFIFKEWKRLDKAKKVMENQMFEEKQAESMPEIETEQEYKEIFITPHQIKHIKDFKDYK YSHRVDKKPNRELINDTLYSTRKDDKGNTLIVNNLNGLYDKDNDKLKKLINKSPEKLLMY HHDPQTYQKLKLIMEQYGDEKNPLYKYYEETGNYLTKYSKKDNGPVIKKIKYYGNKLNA HLDITDDYPNSRNKVVKLSLKPYRFDVYLDNGVYKFVTVKNLDVIKKENYYEVKSKCYEE AKKLKKISNQAEFIASFYNNDLIKINGELYRVIGVNNDLLNRIEVNMIDITYREYLENMND KRPPHIIKTIASKTQSIKKYSTDILGNLYEVKSNKHPQIIKKG | 53. |
| ATRGLMNLLRSYFRVNNLDVKVKSINGGFTSFLRRKWKFKKERNKGYKHHAEDALIIAN ADFIFKEWKKLDKAKKVMENQMFEEKQAESMPEIETEQEYKEIFITPHQIKHIKDFKDYK YSHRVDKKPNRELINDTLYSTRKDDKGNTLIVNNLNGLYDKDNDKLKELINKSPEKLLMY HHDPQTYQKLKLIMEQYGDEKNPLYKYYEETGNYLTKYSKKDNGPVIKKIKYYGNKLNA HLDITDDYPNSRNMVVKLSLKPYRFDVYLDNGVYKFVTVKNLDVIKKENYYEVNSKCYEE AKKLKKISNQAEFMASFYKNDLIKFNGELYRVIGVNNDLLNRIEVNMIDITYREYLENMN DKRPPHIIKTIASKTQSIKKYSTDILGNLYEVKSKKHPQIIKKG | 54. |
| ATRGLMNLLRSYFRVNNLDIKVKSINGGFTSFLRRKWKFKKERNKGYKHHAEDALIIANA DFIFKEWKKLDKAKKVMENQMFEEKQAESMPEIETEQEYKEIFITPHQIKHIKDFKDYKY SHRVDKKPNRELINDTLYSTRKDDKGNTLIVNNLNGLYDKDNDKLKKLINKSPEKLLMYH HDPQTYQKLKLIMEQYGDEKNPLYKYYEETGNYLTKYSKKDNGPVIKKIKYYGNKLNAHL NITDDYPNSRNKVVKLSLKPYRFDVYLDNGVYKFVTVKNLDVIKKENYYEVNSKCYEEAK KLKKISNQAEFISSFYSNDLIKINGELYRVIGVNNDLLNRIEVNMIDITYREYLENMNDKRP PHIIKRIASKTQSIKKYSTDILGNLYEVKSKKHPQIIKKG | 55. |
| ATRGLMNLLRSYFRVNNLDVKVKSINGGFTSFLRRKWKFKKERNKGYKHHAEDALIIAN ADFIFKEWKKLDKAKKVMENQMFEEKQAESMPEIETEQEYKEIVITPHQIKHIKDFKDYK YSHRVDKKPNRELINDTLYSTRKDDKGNTLIVNNLNGLYDKDNDKLKKLINKSPEKLLMY HHDPQTYQKLKLIMEQYGDEKNPLYKYYEETGNYLTKYSKKDNGPVIKKIKYYGNKLNA HLDITDDYPNSRNKVVKLSLKPYRFDVYLDNGVYKFVTVKNLDVIKKENYYEVNSKCYEE AKKLKKISNQAEFIASFYNNDLIKINGELYRVIGVNNDLLNRIEVNMIDITYREYLENMND KRPPHIIKTIASKTQSIKKYSTDILGNLYEVKSKKHPEIIKKG | 56. |
| ATRGLMNLLRSYFRVNNLDVKVKSINGGFTSFLRRKWKFKKERNKGYKHHAEDALIIAN ADFIFKEWKKLDKAKKVMENQMFEEKQAESMPEIETEQEYKEIFITPHQIKHIKDFKDYK YSHRVDKKPNRELINDTLYSTRKDDKGNTLIVNNLNGLYDKDNDKLKKLINKSPEKLLMY HHDPQTYQKLKLIMEQYGDEKNPLYKYYEETGNYLTKYSKKDNGPVIKKIKYYGNKLNA HLDITDDYPNSRNKVVKLSLKPYRFDVYLDNGVYKFVTVKNLDVIKKENYYEVNSKCYEE AKKLKKISNQAEFIASFYNNDLIRINGELYRVIGVNNDLLNRIEVNMIDITYREYLENMND KRPPHIIKTIASKTQSIKKYSTDILGNLYEVKSKKHPQIIKKG | 57. |

TABLE 6-continued

| residues A652-G1053 of SaCas9 | SEQ ID NO: |
|---|---|
| ATRGLMNLLRSYFRVNNLDVKVKSIKGGFTSFLRRKWKFKKERNKGYKHHAEDALIIAN ADFIFKEWKKLDKAKKVMENQMFEEKQAESMPEIETEQEYKEIFITPHQIKHIKDFKDFK YSHRVDKKPNRELINDTLYSTRKDDKGNTLIVNNLNGLYDKDNDKLKKLINKSPEKLLMY HHDPQTYQKLKLIMEQYGDEKNPLYKYYEETGNYLTKYSKKDNGPVIKKIKYYGNKLNA HLDITDNYPNSRNKVVKLSLKPYRFDVYLDNGVYKFVTVKNLDVIKKENYYEVNSKCYEE AKKLKKISNQAEFIASFYNNDLIKINGELYRVIGVNNDLLNRIEVNMIDITYRGYLENMND KRPPHIIKTIASKTQSIKKYSTDILGNLYEVKSKKHPQIIKKG | 58. |
| ATRGLMNLLRSYFRVNNLDVKVKSINGGFTSFLRRKWKFKKERNKGYKHHAEDALIIAN ADFIFKEWKKLDKAKKVMENQMFEEKQAESMPEIETEQEYKEIFITPHQIKHIKDFKDYK YSHRVDKKPNRELINDTLYSTRKDDKGNTLIVNNLNGLYDKDNDKLKKLINKSPEKLLMY HHDPQTYQKLKLIMEQYGDEKNPLYKYYEETGNYLTKYSKKDNGPVIKKIKYYGNKLNA HLDITDDYPNSRNKVVKLSLKPYRFDVYLDNGVYKFVTVKNLDVIKKENYYEVNSKCYEE AKKLKKISNQAEFIASFYNNDLIKINGELYRVIGVNNDLLNRIEVNMIDITYREYLENMKD KRPPHIIKTIASKTQSIIKYSTDILGNLYEVKSKKHPQIIKKG | 59. |
| ATRGLMNLLRSYFRVNNLDVKVKSINGGFTSFLRRKWKFKKERNKGYKHHAEDALIIAN ADFIFKEWKKLDKAKKVMENQMFEEKQAESMPEIETEHEYKEIFITPHQIKHIKDFKDYK YSHRVDKKPNRELINDTLYSTRKDDKGNTLIVNNLNGLYDKDNDKLKKLINKSPEKLLMY HHDPQTYQKLKLIMEQYGDEKNPLYKYYEETGNYLTKYSKKDNGPVIKKIKYYGNKLNA HLDITDDYPNSRNKVVKLSLKPYRFDVYLDNGVYKFVTVKNLDVIKKENYYEVNSKCYEE AKKLKKISNQAEFIASFYNNDLIKINGELYRVIGVNNDLLNRIEVNMIDITYREYLENMND KRPPHIIKTIASKTQSIKKYSTDILGNLYEVKSNKHPQIIKKG | 60. |
| ATRGLMNLLRSYFRVNNLDVKVKSINGGFTSFLRRKWKFKKERNKGYKHHAEDALIIAN ADFIFKEWKKLDKAKKVMENQMFEEKQAESMPEIETEQEYKEIFITPHQIKHINDFKDYK YSHRVDKKPNRELINDTLYSTRKDDKGNTLIVNNLNGLYDKDNDKLKKLINKSPEKLLMY HHDPQTYQKLKLIMEQYGDEKNPLYKYYEETGNYLTKYSKKDNGPVIKKIKYYGNKLNA HLDITDDYPNSRNKVVKLSLKPYRFDVYLDNGVYKFVTVKNLDVIKKENYYEVNSKCYEE AKKLKKISNQAEFIASFYNNDLIKINGELYRVIGVNNDLLNRIEVNMIDITYREYLENMND KRPPHIIKTIASKTQSIKKYSTDILGNLYEVKSKKRPQIIKKG | 61. |
| ATRGLMNLLRSYFRVNNLDVKVKSINGGFTSFLRRKWKFKKERNKGYKHHAEDALIIAN ADFIFKEWKKLDKAKKLMENQMFEEKQAESMPEIETEQEYKEIFITPHQIKHIKDFKDYK YSHRVDKKPNRELINDTLYSTRKDDKGNTLIVNNLNGLYDKDNDKLKKLINKSPEKLLMY HHDPQTYQKLKLIMEQYGDEKNPLYKYYEETGNYLTKYSKKDNGPVIKKIKYYGNKLNA HLDITDDYPNSRNKVVKLSLKPYRFDVYLDNGVYKFVTVRNLDVIKKENHYEVNSKCYEE AKKLKKISNQAEFIASFYNNDLIKINGELYRVIGVNNDLLNRIEVNMIDITYREYLENMND KRPPQIIKTIASKTQSIKKYSTDILGNLYEVKSKKHPQIIKKG | 62. |
| ATRGLMNLLRSYFRVNNLDVKVKSINGGFTSFLRRKWKFKKERNKGYKHHAEDALIIAN ADFIFKEWKKLDKAKKVMENQMFEEKQAESKPEIETEQEYKEIFITPHQIKHIKDFKDYKY SHRVDKKPNRKLINDTLYSTRKDDKGNTLIVNNLNGLYDKDNDKLKKLINKSPEKLLMYH HDPQTYQKLKLIMEQYGDEKNPLYKYYEETGNYLTKYSKKDNGPVIKKIKYYGNKLNAHL DITDDYPNSRNKVVKLSLKPYRFDVYLDNGVYKFVTVKNLDVIKKENYYEVNTKCYEEAK KLKKISNQAEFIASFYNNDLIKINGELYRVIGVNNDLLNRIEVNMIDITYREYLENMNDKR PPQIIKTIASKTQSIKKYSTDILGNLYEVKSKKHPQIVKKG | 63. |
| ATRGLMNLLRSYFRVNNLDVKVKSINGGFTSFLRRKWKFKKERNKGYKHHAEDALIIAN ADFIFKEWKKLDRAKKVMENQMFEEKQAESMPEIETEQEYKEIFITPHQIKHIKDFKDYK YSHRVDKKPNRELINDTLYSTRKDDKGYTLIVNNLNGLYDKDNDKLKKLINKSPEKLLMY HHDPQTYQKLKLIMEQYGDEKNPLYKYYEETGNYLTKYSKKDNGPVIKKIKYYGNKLNA HLDITDDYPNSRNKVVKLSLKPYRFDVYLDNGVYKFVTVKNLDVIKKENYYEVNSKCYEE AKKLKKISNQAEFIASFYNNDLIKINGELYRVIGVNNDLLNRIEVNMIDITYREYLENMND KRPPQIIKTITSKTQSIKKYSTDILGNLYEVKSKKQPQIIKKG | 64. |
| ATRGLMNLLRSYFRVNNLDVKVKSINGGFTSFLRRKWKFKKERNKGYKHHAEDALIIAN ADFIFKEWKKLDKAKKVMENQMFEEKQAESMPEIETEQEYKEIFITPHQIKHIKDFKDYK YSHRVDKKPNRKLINDTLYSTRKDDKGNTLIVNNLNGLYDKDNDKLKKLINKSPEKLLMY HHDPQTYQKLKLILEQYGDEKNPLYKYYEETGNYLTKYSKKDNGPVIKKIKYYGNKLNAH LDITDDYPNSRNKVVKLSLKPYRFDVYLDNGVYKFVIVKNLDVIKKENYYEVNSKCYEEA KKLKKISNQAEFIASFYNNDLIKINGELYRVIGVNNDLLNRIEVNMIDITYREYLENMNDK RPPQIIKTIASKTQSIKKYSTDILGNLYEVKSKKHPQIIKKG | 65. |
| ATRGLMNLLRSYFRVNNLDVKVKSINGGFTSFLRRKWKFKKERNKGYKHHAEDALIIAN ADFIFKEWKKLDKAKKVMENQMFEEKQAESMPEIETEQEYKEIFITPHQIKHIKDFKDYK YSHRVDKKPNRKLINDTLYSTRKDDKGNTLIVNNLNGLYDKDNDKLKKLINKSPEKLLMY HHDPQTYQKLKLIMEQYGDEKNPLYKYYEETGNYLTKYSKKDNGPVIKKIKYYGNKLNA HLDITDDYPNSRNKVVKLSLKPYRFDVYLDNGIYKFVTVKNMDVIKKENYYEVNSKCYEE AKKLKKISNQAEFIASFYNNDLIKINGELYRVIGVNNDLLNRIEVNMIDITYREYIENMND KRPPQIIKTIASKTQSIKKYSTDILGNLYEVKSKKHPQIIKKG | 66. |
| ATRGLMNLLRSYFRVNNLDVKVKSINGGFTSFLRRKWKFKKERNKGYKHHAEDALIIAN ADFIFKEWKKLDKAKKVMENQMFEEKQAESMPEIETEQEYKEIFITPHQIKHIKDFKDYK YSHRVDKKPNRELINDTLYSTRKDDKGNTLIVNNLNGLYDKDNDKLKKLINKSPEKLLMY HHDPQTYQKLKLIMEQYGDEKNPLYKYYEETGNYLTKYSKKDNGPVIKKIKYYGNKLNA | 67. |

TABLE 6-continued

| residues A652-G1053 of SaCas9 | SEQ ID NO: |
|---|---|
| HLDITDDYPNSRNKVVKLSLKPYRFDVYLDNGVYKFVTVRNLDVIKKENYYEVNSKCYEE<br>AKKLKKISNQAEFIASFYNNDLIKINGELYRVIGVNNDLLNRIEVNMIDITYREYLENMND<br>KRPPQIIKTIASKTQSIKKYSTDILGNLYEVKSKKHPQVIKKG | |
| ATRGLMNLLRSYFRVNNLDVKVKSINGGFTSFLRRKWKFKKERNKGYKHHAEDALIIAN<br>ADFIFKEWKRLDKAKKVMENQMFEEKQAESMPEIETEQEYKEIFITPHQIKHIKDFKDYK<br>YSHRVDKKPNRELINDTLYSTRKDDKGNTLIVNNLNGLYDKDNDKLKKLINKSPEKLLMY<br>HHDPQTYQKLKLIMEQYGDDKNPLYKYYEETGNYLIKYSKKDNGPVIKKIKYYGNKLNAH<br>LDITDDYPNSRNKVVKLSLKPYRFDVYLDNGVYKFVTVRNLDVIKKENYYEVNSKCYEEA<br>KKLKKISNQAEFIAYFYNNDLIKINGELYRVIGVNNDLLNRIEVNMIDITYREYLENMNDK<br>RPPQIIKTIASKTQSIKKYSTDILGNLYEVKSKKHPQIIK*G | 68. |
| ATRGLMNLLRSYFRVNNLDVKVKSINGGFTRFLRRKWKFKKERNKGYKHHAEDALIIAN<br>ADFIFKEWKKLDKAKKVMENQMFEEKQAESMPEIETEQEYKEIFITPHQIKHIKDFKDYK<br>YSHRVDKKPNRKLINDTLYSTRKDDKGNTLIVNNLNGLYDKDNDKLKKLINKSPEKLLMY<br>HHDPQTYQKLKLIMEQYGDEKNPLYKYYEETGNYLTKYSKKDNGPVIKKIKYYGNKLNA<br>HLDITDDYPNSRNKVVKLSLKPYRFDVYLDNGVYKFVTVKNLDVIKKENYYEVNSKCYEE<br>AKKLKKISNQAEFIASFYNNDLIKINGELYRVIGVNNDLLNRIEVNMIDITYREYLENMND<br>KRPPQIIKTIASKTQSIKKYSTDILGNLYEVKSKKHPQITKKG | 69. |
| ATRGLMNLLRNYFRVNNLDVKVKSINGGFTSFLRRKWKFKKERNKGYKHHAEDALIIAN<br>ADFIFKEWKKLDKAKKVMENQMFEEKQAESMPEIETEQEYKEIFITPHQIKHIKDFKDYK<br>YSHRVDKKPNRELINDTLYSTRKDDKGNTLIVNNLNGLYDKDNDKLKKLINKSPEKLLMY<br>HHDQQTYQKLKLIMEQYGDEKNPLYKYYEETGNYLTKYSKKDNGPVIKKIKYYGNKLNA<br>HLDITDDYPNSRNKVVKLSLKPYRFDVYLDNGVYKFVIVKNLDVIKNENYYEVNSKCYEE<br>AKKLKKISNQAEFIASFYNNDLIKINGELYRVIGVNNDLLNRIEVNMIDITYREYLENMND<br>KRPPQNIKTIASKTQSIKKYSTDILGNLYEVKSKKHPQII*KG | 70. |
| ATRGLMNLLRSYFRVNNLDVKVKSINGGFTSFLRRKWKFKKERNKGYKHHAEDALIIAN<br>ADFIFKEWKKLDKAKKVMENQMFEEKQAESMPEIETEQEYKEIFITPHQIKHIKDFKDYK<br>YSHRVDKKPNRKLINDTLYSTRKDDKGNTLIVNNLNGLYDKDNDKLKKLINKSPEKLLMY<br>HHDPQTYQKLKLIMEQYGDEKNPLYKYYEETGYYLTKYSKKDNGPVIKKIKYYGNKINAH<br>LDITDDYPNSRNKVVKLSLKPYRFDVYLDNGVYKFVIVKNLDVIKKENYYEVNSKCYEEA<br>KKLKKISNQAEFIASFYNNDLIKINGELYRVIGVNNDLLNRIEVNMIDITYREYLENMNDK<br>RPPQIIKTIASKTQSIKKYSTDILGNLYEVKSKKHPQIVKKG | 71. |
| ATRGLMNLLRSYFRVNNLDVKVKSINGGFTSFLRRKWKFKKERNKGYKHHAEDALIIAN<br>ADFIFKEWKKLDKAKKVMENQMFEEKQAESMPEIETEQEYKEIFITPHQIKHIKDFKDYK<br>YSHRVDKKPNRELINDTLYSTRKDDKGNTLIVNNLNGLYDKDNDKLKKLINKSPEKLLMY<br>HHDPQTYQKLKLIMEQYGDEKNPLYKYYEETGNYLTKYSKKDNGPVIKKIKYYGNKLNA<br>HLDITDDYPNSRNKVVKLSLKPYRFDVYLDNGVYKFVTVKNLDVIKKENYYEVNSKCYEE<br>AKKLKKISNQAEFIASFYNNDLIKINGELYRVIGVNNDLLNRIEVNMIDITYREYLENMND<br>KRPPQIIKTIASKTQSIKKYSTDILGNLYEVKSKKHPQIIKKG | 72. |
| ATRGLMNLLRSYFRVNNLDVKVKSINGGFTSFLRRKWKFKKERNKGYKHHAEDALIIAN<br>ADFIFKEWKKLDKAKKVMENQMFEEKQAESMPEIETEQEYKEIFITPHQIKHIKDFKDYK<br>YSHRVDKKPNRELINDTLYSTRKDDKGNTLIVNNLNGLYDKDNDKLKKLINKSPEKLLMY<br>HHDPQTYQKLKLIMEQYGDEKNPLYKYYEETGNYLTKYSKKDNGPVIKKIKYYGNKLNA<br>HLDITDDYPNSRNKVVKLSLKPYRFDVYLDNGVYKFVTVKNLDVIKKENYYEVNSKCYEE<br>AKKLKKISNQAEFIASFYKNDLIKINGELYRVIGVNNDLLNRIEVNMIDITYREYLENMND<br>KRPPQIIKTIASKTQSIKKYSTDILGNLYEVKSKKHPQIIKKG | 73. |
| ATRGLMNLLRSYFRVNNLDVKVKSINGGFTSFLRRKWKFKKERNKGYKHHAEDALIIAN<br>ADFIFKEWKKLDKAKKLMENQMFEEKQAESMPEIETEQEYKEIFMTPHQIKHIKDFKDY<br>KYSHRVDKKPNRELINDTLYSTRKDDKGNTLIVNNLNGLYDKDNDKLKKLINKSPEKLLM<br>YHHDPQTYQKLKLIMEQYGDEKNPLYKYHEETGNYLTKYSKKDNGPVIKKIKYYGNKLN<br>AHLDITDDYPNSRNKVVKLSLKPYRFDVYLDNGVYKFVTVKNLDVIKKENYYEVNSKCYE<br>EAKKLKKISNQAEFIASFYNNDLIKINGELYRVIGVNNDLLNRIEVNMIDITYREYLENMN<br>DKRPPHIIKTIASKTQSIKKYSTDILGNLYEVKSKKHPQIIKKG | 74. |
| ATRGLMNLLRSYFRVNNLDVKVKSINGGFTSFLRRKWKFKKERNKGYKHHAEDALIIAN<br>ADFIFKEWKKLDKAKKVMENQMFEEKQAESMPEIETEQEYKEIFITPHQIKHIKDFKDYK<br>YSHRVDKKPNRELINDTLYSTRKDDKGNTLIVNNLNGLYDKDNDKLKKLINKSPEKLLMY<br>HHDPQTYQKLKLIMEQYGDEKNPLYKYYEETGNYLTKYSKKDIGPVIKKIKYYGNKLNAH<br>LDITDDYPNSRNKVVKLSLKPYRFDVYLDNGVYKFVIVKNLDVIKKENYYEVNSKCYEEA<br>KKLKKISNQAEFIASFYNNDLIKINGELYRVIGVNNDLLNRIEVNMIDITYREYLENMNYK<br>RPPQIIKTIASKTQSIKKYSSDILGNLYEVKSKKHP*IIKKG | 75. and 966 |
| ATRGLMNLLRSYFRVNNLDVKVKSINGGFTSFLRRKWKFKKERNKGYKHHAEDALIIAN<br>ADFIFKEWKKLDKAKKVMENQMFEEKQAESMPEIETEQEYKEIFITPHQIKHIKDFKDYK<br>YSHRVDKKPNRKLINDTLYSTRKDDKGNTLIVNNLNGLYDKDNDKLKKLINKSPEKLLMY<br>HHDPQTYQKLKLIMEQYGDEKNPLYKYYEETGNYLTKYSKKDNGPVIKKIKYYGNKLNA<br>HLDITDDYPNSRNKVVKLSLKPYRFDVYLDNGVYKFVTVKNLDVIKKENYYEVNSKCYEE<br>AKKLKKISNQAEFIASFYNNDLIKINGELYRVIGVNNDLLNRIEVNMIDITYREYLENMND<br>KRPPQIINTIASKTQSIKKYSTDILGNLYEVKSKKHPQIIKKG | 76. |

TABLE 6-continued

| residues A652-G1053 of SaCas9 | SEQ ID NO: |
|---|---|
| ATRGLMNLLRSYFRVNNLDVKVKSINGGFTSFLRRKWKFKKERNKGYKHHAEDALIIAN<br>ADFIFKEWKKLDKAKKVMENQMFEEKQAESMPEIETEQEYKELFITPHQIKHIKDFKDYK<br>YSHRVDKKPNRELINDTLYSTRKDDKGNTLIVNNLNGLYDKDNDKLKKLINKSPEKLLMY<br>HHDPQTYQKLKLIMEQYGDEKNPLYKYYEETGNYLTKYSKKDNGPVIKKIKYYGNKLNA<br>HLDITDDYPNSRNKVVKLSLKPYRFDVYLDNGVYKFVTVKNLDVIKKENYYEVNSKCYEE<br>AKKLKKISNQAEFIASFYKNDLIKINGELYRVIGVNNDLLNRIEVNMIDITYREYLENMND<br>KRPPQIIKTIASKTQSIKKCSTDILGNLYEVKSKKHPQIIKKG | 77. |
| ATRGLMNLLRSYFRVNNLDVKVKSINGGFTSFLRRKWKFKKERNKGYKHHAEDALIIAN<br>ADFIFKEWKKLDKAKKVMENQMFEKKQAESMPEIETEQEYKEIFITPHQIKHIKDFKDYK<br>YSHRVDKKPNRGLINDTLYSTRKDDKGNTLIVNNLNGLYDKDNDKLKKLINKSPEKLLMY<br>HHDPQTYQKLKLIMEQYGDEKNPLYKYYEDTGNYLTKYSKKDNGPVIKKIKYYGNKLNA<br>HLDITDDYPNSRNKVVKLSLKPYRFDVYLDNGVYKFVTVKNLDLIKKENYYEVNSKCYEE<br>AKKLKKISNQAEFIASFYNNDLIKINGELYRVIGVNNDLLNRIEVNMIDITYREYLENVNDK<br>RPPQIIKTIASKTQSIKKYSTDILGNLYEVKSKKHPQIIKKG | 78. |
| ATRGLMNLLRSYFRVNNLDVKVKSINGGFTSFLRRKWKFKKERNKGYKHHAEDALIIAN<br>ADFIFKEWKKLDKAKKVMENQMFEEKQAESMPEIETEQEYKEIFITPHQIKHIKDFKDYK<br>YSHRVDKKPNRKLINDTLYSTRKDDKGNTLIVNNLNGLYDKDNDKLKKLINKSPEKLLMY<br>HHDPQTYQKLKLIMEQYGDEKNPLYKYYEETGNYLTKYSKKDNGPVIKKIKYYGNKLNA<br>HLDITDDYPNSRNKVVKLSLKPYRFDVYLDNGIYKFVTVKNLDVIKKENYYEVNSKCYEKA<br>KKLKKISNQAEFIASFYNNDLIKINGELYRVIGVNNDLLNRIEVNMIDITYREYLENMNDK<br>RPPQIIKTIASKTQSIKKYSTDILGNLYEVKSNKHPQIIKKG | 79. |
| ATRGLMNLLRSYFRVNNLDVKVKSINGGFTSFLRRKWKFKKERNKGYKHHAEDALIIAN<br>ADFIFKEWKKLDKAKKVMENQMFEEKQAESMPEIETEQEYKEIFIIPHQIKHIKDFKDYK<br>YSHRVDKKPNRKLINDTLYSTRKDDKGNTLIVNNLNGLYDKDNDKLKKLINKSPEKLLMY<br>HHDPQTYQKLKLIMEQYGDEKNPLYKYYEETGNYLTKYSKKDNGPVIKKIKYYGNKLNA<br>HLDITDDYPNSRNKVVKLSLKPYRFDVYLDNGVYKFVTVKNLDVIKKENYYEVNSKCYEE<br>AKKLKKISNQAEFIASFYNNDLIKINGELYRVIGVNNDLLNRIEVNMIDITYREYLENMND<br>KRPPQIIKTIASKTQSIKKYSTDILGNLYEVKSKKHPQIIKKG | 80. |
| ATRGLMNLLRSYFRVNNLDVKVKSINGGFTSFLRRKWKFKKERNKGYKHHAEDALIIAN<br>ADFIFKEWKKLDKAKKVMENQMFEEKQAESMPEIETEQQEYKEIFITPHQIKHIKDFKDYK<br>YSHRVDKKPNRKLINDTLYSTRKDDKGNTLIVNNLNGLYDKDNDKLKKLINKSPEKLLMY<br>HHDPQTYQKLKLIMEQYGDEKNPLYKYYEETGNYLTKYSKKDNGPVIKKIKYYGNKLNA<br>HLDITDDYPNSRNKVVKLSLKPYRFDVYLDNGVYKFVTVKNLDVIKKENYYEVNSKCYEE<br>AKKLKKISNQAEFIASYYNNDLIKINGELYRVIGVNNDLLNRIEVKMIDITYREYLENMND<br>KRPPQIIKTIASKTQSIKKYSTDILGNLYEVKSKKHPHIIKKG | 81. |
| ATRGLMNLLRSYFRVNNLDVKVKSINGGFTSFLRRKWKFKKERNKGYKHHAEDALIIAN<br>ADFIFKEWKKLDKAKKVMENQMFEEKQAESMPEIETEQEYKEIFITPHQIKHIKDFKDYK<br>YSHRVDKKPNRKLINDTLYSTRKDDKGNTLIVNILNGLYDKDNDKLKKLINKSPEKLLMYH<br>HDPQTYQKLKLIMEQYGDEKNPLYKYYEETGNYLTKYSKKDNGPVIKKIRYYGNKLNAHL<br>DITDDYPNSRNKVVKLSLKPYRFDVYLDNGVYKFVTVKNLDVIKKENYYEVNSKCYEEAK<br>KLKKISNQAEFIASFYNNDLIKINGELYRVIGVNNDLLNRIEVNMIDITYREYLENMNDKR<br>PPQIIKTIASKTQSIKKYSTDILGNLYEVKSKKHPQIIKKG | 82. |
| ATRGLMNLLRSYFRVNNLDVKVKSINGGFTSFLRRKWKFKKERNKGYKHHAEDALIIAN<br>ADFIFKEWKKLDKAKKVMENQMFEEKQAESMPEIETEQEYKEIFITPHQIKHIKDFKDYK<br>YSHRVDKKPNRKLINDTLYSTRKDDKGNTLIVNNLNGLYDKDNDKLKKLINKSPEKLLMY<br>HHDPQTYQKLKLIMEQYGDEKNPLYKYYEETGNYLTKYSKKDNGPVIKKIKYYGNKLNA<br>HLDITDDYPNSRNKVVKLSLKPYRFDVYLDNGVYKFVTVKNLDVIKKENYYEVNSKCYEE<br>AKKLKKISNQAEFIASFYNNDLIKINGELYRVIGVNNDLLNRIEVNMIDITYREYFENMV<br>KRPPQIIKTIASKTQSIKKYSTDILGNLYEVKSKKHPQIIKKG | 83. |
| ATRGLMNLLRSYFRVNNLDVKVKSINGGFTSFLRRKWKFKKERNKGYKHHAEDALIIAN<br>ADFIFKEWKKLDKAKKVMENQMFEEKQAESMPEIETEQEYKEIFITPHQIKHIKDFKDYK<br>YSHRVDKKHNRELVNDTLYSTRKDDKGNTLIVNNLNGLYDKDNDKLKKLINKSPEKLLM<br>YHHDPQTYQKLKLIMEQYGDEKNPLYKYYEETGNYLTKYSKKDNGPVIKKIKYYGNKLNA<br>HLDITDDYPNSRNKVVKLSLKPYRFDVYLDNGVYKFVTVKNLDVIKKENYYEVNSKCYEE<br>AKKLKKISNQAEFIASFYNNDLIKINGELYRVIGVNNDLLNRIEVNMIDITYREYLENMND<br>KRPPQIIKTITSKTQSIKKYSTDILGNLYEVKSKKHPQIIKKG | 84. |
| ATRGLMNLLRSYFRVNNLDVKVKSINGGFTSFLRRKWKFKKERNKGYKHHAEDALIIAN<br>ADFIFKEWKKLDKAKKVMENQMFEEKQAESMPEIETEQEYKEIFITPHQIKHIMDFKDY<br>KYSHRVDKKPNRELINDTLYSTRKDEKGNTLIVNNLNGLYDKDNDKLKKLINKSPEKLLM<br>YHHDPQTYQKLKLIMEQYGDEKNPLYKYYEETGNYLTKYSKKDNGPVIKKIKYYGNKLNA<br>HLDITDDYPNSRNKVVKLSLKPYRFDVYLDNGVYKFVTVRNLDVIKKENYYEVNSKCYEE<br>AKKLKKISNQAEFIASFYNNDLIKINGELYRVIGVNNDLLNRIEVNMIDITYREYLENMND<br>KRPPQIIKTIASKTQSIKKYSTDILGNLYEVKSKKHPQIIKKG | 85. |
| ATRGLMNLLRSYFRVNNLDVKVKSINGGFTSFLRRKWKFKKERNKGYKHHAEDALIIAN<br>ADFIFKEWKKLDKAKKVMENQMFEEKQAVSMPEIETEQEYKEIFINPHQIKHIKDFKDY<br>KYSHRVDKKPNRELINDTLYSTRKDDKGNTLIVNNLNGLYDKYNDKLKKLINKSPEKLLM<br>YHHDPQTYQKLKLIMEQYGDEKNPLYKYYEETGNYLTKYSKKDNGPVIKKIKYYGNKLNA | 86. |

TABLE 6-continued

| residues A652-G1053 of SaCas9 | SEQ ID NO: |
|---|---|
| HLDITDDYPNSRNKVVKLSRKPYRFDVYLDNGVYKFVTVKNLDVIKKENYYEVNSKCYEE<br>AKKLKKISNQAEFIASFYNNDLIKINGELYRVIGVNNDLLNRIEVNMIDITYREYRENMND<br>KRPPQIIKTIASKTQSIKKYSTDILGNLYEVKSKKHPQIIKKG | |
| ATRGLMNLLRSYFRVNNLDVKVKSINGGFTSFLRRKWKFKKERNKGYKHHAEDALIIAN<br>ADFIFKEWKKLDKAKKVMENQMFEEKQAESMPEIETEQEYKEIFITPHQIKHIKDFKDYK<br>YSHRVDKKPNRELINDTLYSTRKDDKGNTLIVNNLNGLYDKDNDKLKKLINKSPEKLLMY<br>HHDPQTYQKLKLIMEQYGDEKNPLYKYYEETGNYLTKYSKKDNGPVIKKIKYYGNKLNA<br>HLDITDDYPNSRNKVVKLSLKPYRFDVYLDNGVYKFVIVKNLDVIKNENYYEVNSKCYEE<br>AKKLKKISNQAEFIASFYNNDLIKINGELYRVIGVNNDLLNRIEVNMIDITYREYLENINGK<br>RPPQIIKTITSKTQSIKKYSTDILGNLYEVKSKKHPQIIKKG | 87. |
| ATRGLMNLLRSYFRVNNLDVKVKSINGGFTSFLRRKWKFKKERNNGYKHHAEDALIIAN<br>ADFIFKEWKKLDKAKKVMENQMFEEKQAESMPEIETEQEYKEIFITPHQIKHIKEFKDYK<br>YSHRVDKKPNRKLINDTLYSTRKDDKGNTLIVNNLNGLYDKDNDKLKKLINKSPEKLLMY<br>HHDPQTYQKLKLIMEQYGDEKNPLYKYYEETGIYLTKYSKKDNGPVIKKIKYYGNKLNAH<br>LDITDDYPNSRNKVVKLSLKPYRFDVYLDNGVYKFVTVKNLDVIKKENYYEVNSKCYGEA<br>KKLKKISNQAEFIASFYNNDLIKINGELYRVIGVNNDLLNRIEVNMIDITYREYLEIMNDKR<br>PPQIIKTIASKTQSIKKYSTDILGNLYEVKSNKHPQIIKKG | 88. |
| ATRGLMNLLRSYFRVNNLDVKVKSINGGFTSFLRRKWKFKKERNKGYKHHAEDALIIAN<br>ADFIFKEWKKLDKAKKVMENQMFEEKQAESMPEIETEQEYKEIVIFITPHQIKHIKDFKDYK<br>YSHRVDKKPNRKLINDTLYSTRKDDKGNTLIVNNLNGLYDKDNDKLKKLINKSPEKLLMY<br>HHDPQTYQKLKLIMEQYGDEKNPLYIYYEETGNYLTKYSKKDNGPVIKKIKYYGNKLNAH<br>LDITDDYPNSRNKVVKLSLKPYRFDVYLDNGVYKFVIVKNLDVIKKENYYEVNSKCYEEA<br>KKLKKISNQAEFIASFYNNDLIKINGELYRVIGVNNDLLNRIEVNMIDITYREYLENMNDK<br>RPPQIIKTIASKTQSIKKYSTDILGNVYEVKSKKHPQIIKKG | 89. |
| ATRGLMNLLRSYFRVNNLDVKVKSINGGFTSFLRRKWKFKKERNKGYKHHAEDALIIAN<br>ADFIFKEWKKLDKAKKVMENQMFEEKQAESMPEIETEGQEYKEIFITPHQIKHIKDFKDYK<br>YSHRVDKKPNRKLINDTLYSTRKDDKGNTLIVNNLNGLYDKDNDKLKKLINKSPEKLLMY<br>HHDPQTYQKLKLIMEQYGDEKNPLYKYYEETGNYLTKYSKKDNGPVIKKIKYYGNKLNA<br>HLDITDDYPNSRNKVVKLSLKPYRFDVYLDNGVYKFVTVKNLDVIKKENYYEVNSKCYEE<br>AKKLKKISNQAEFIASFYNNDLIKINGELYRVIGVNNDLLNRIEVNMIDITYREYLENMND<br>KRPPQIIKTIASKTQSIKKYSTDILGNLYEVKSKKHPQIIKKG | 90. |
| ATRGLMNLLKSYFRVNNLDVKVKSINGGFTSFLRRKWKFKKERNKGYKHHAEDALIIAN<br>ADFIFKEWKKLDKSKKVMENQMFEEKQAESMPEIETEQEYKEIFITPHQIKHIKDFKDYK<br>YSHRVDKKHNRKLINDTLYSTRKDDKGNTLIVNNINGLYDKDNDKLKKLINKSPEKLLMY<br>HHDPQTYQKLKLIMEQYGDEKNPLYKYYEETGNYLTKYSKKDNGPVIKKIKYYGNKLNA<br>HLDITDDYPNSRNKVVKLSLKPYRFDVYLDNGVYKFVTVKNLDVIKKENYYEVNSKCYEE<br>AKKLKKISNQAEFIASFYNNDLIKINGELYRVIGVNNDLLNRIEVNTIDITYREYLENMNDK<br>RPPQIIKTIASKTQSIKKYSTDILGNLYEVKPKKHPQIIKKG | 91. |
| ATRGLMNLLRSYFRVNNLDVKVKSINGGFTSFLRRKWKFKKERNKGYKHHAEDALIIAN<br>ADFIFKEWKKLDKAKKVMENQMFEEKQAESMPEIETEQEYKEIFITPHQIKHIKDFKDYK<br>YSHRVDKKPNRKLINDTLYSTREDDKGNTLIVNNLNGLYDKDNDKLKKLINKSPEKLLMY<br>HHDPQTYQKLKLIMEQYGDEKNPLYKYYEETGNYLTKYSKKDNGPVIKKIKYYGNKLNA<br>HLDISDDYPNSRNKVVKLSLKPYRFDVYLDNGVYKFVTVKNLDVIKKENYYEVNSKCYEE<br>AKKLKKISNQAEFIASFYNNDLIKINGELYRVIGVNNDLLNRIEVNMIYITYREYLENMND<br>KRPPQIIKTIASKTQSIKKYSTDILGNLYEVKSKKHP*IIKKG | 92. and 966 |
| ATRGLMNLLRSYFRVNNLDVKVKSINGGFTSFLRRKWKFKKERNKGYKHHAEDALIIAN<br>ADFIFKEWKKLDKAKKVMENQMFEEKQAESMPEIETEQEYKEIFITPYQIKHIKDFKDYK<br>YSHRVDKKPNRELINDTLYSTRKDDKGNTLIVNNLNGLYDKDNDKLKKLINKSPEKLLMY<br>HHDPQTYQKLKLIMEQYGDEKNPLYKYYEETGNYLTKYSKKDNGPVIKKIKYYGNKLNA<br>HLDITDDYPNSRNKVVKLSLKPYRFDVYLDNGVYKFVTVRNLDVIKKENYYEVNSKCYEE<br>AKKLKKISNQAEFIASFYNNDLIKINGELYRVIGVNNDLLNRIEVNMIDITYREYLENMND<br>KRPPQIIKTIASKTQSIKKYSTDILGNLYEVKSKKHPQIIKKG | 93. |
| ATRGLMNLLRSYFRVNNLDVKVKSINGGFTSFLRRKWKFKKERNKGYKHHAEDALIIAN<br>ADFIFKEWKKLDNAKKVMENQMFEEKRAESMPEIETEQEYKEIFITPHQIKHIKDFKDFK<br>YSHMVDKKPNRKLINDTLYSTRKDDKGNTLIVNNLNGLYDKDNDKLKKLINKSPEKLLIY<br>HHDPQTYQKLKLIMEQYGDEKNPLYKYYEETGNYLTKYSKKDNGPVIKKIKYYGNKLNA<br>HLDITDDYPNSRNKVVKLSLKPYRFDVYLDNGVYKFVTVKNLDVIKKENYYEVNSKCYEE<br>AKKLKKISNQAEFIASFYNNDLIKINGELYRVIGVNNDLLNRIEVNMIDITYREYLENMND<br>KRPPQIIKTIASKTQSIKKYSTDILGNLYEVKSKKHPQIIKKG | 94. |
| ATRGLMNLLRSYFRVNNLDVKVKSINGGFTSFLRRKWKFKKERNKGYKHHAEDALIIAN<br>ADFIFKEWIRLDKAKKVMENQMFEEKQAESMPEIETEQEYKEIFITPHQIKHIKDFKDYK<br>YSHRVDKKPNRKLINDTLYSTRKDDKGNTLIVNNLNGLYDKDNDKLKKLINKSPEKLLMY<br>HHDPQTYQKLKLIMEQYGDEKNPLYKYYEETGNYLTKYSKKDNGPVIKKIKYYGNKLNA<br>HLDITDDYPNSRNKVVKLSLKPYRFDVYLDNGVYKFVTVKNLDVIKKENYYEVNSKCYEE<br>AKKLKKISNQAEFIASFYNNDLIKINGELYRVIGVNNDLLNRIEVNMIDITYREYLENMND<br>KRPPQIIKTIASKTQSIKKYSTDILGNLYEVKSKKHP*IIKKG | 95. and 966 |

TABLE 6-continued

| residues A652-G1053 of SaCas9 | SEQ ID NO: |
|---|---|
| ATRGLMNLLRSYFRVNNLDVKVKSINGGFTSFLRRKWKFKKERNKGYKHHAEDALIVAN ADFIFKEWKKLDKAKKVMENQMFEEKQAESMPEIETEQEYKEIFITPHQIKHIKDFKDYK YSHRVDKKPNRELINDTLYSTRKDDKGNTLIVINLNGLYDKDNDKLKKLINKSPEKLLMYH HDPQTYQKLKLIMEQYGDEKNPLYKYYEETGNYLTKYSKKDNGPVIKKIKYYGNKLNAHL DITDDYPNSRNKVVKLSLKPYRFDVYLDNGVYKFVTVKNLDVIKKENYYEVNSKCYEEAK KLKKISNQAEFIASFYNNDLIKINGELYRVIGVNNDLLNRIEVNMIDITYREYLENMNDKR PPQIIKTIASKTQSIKKYSTDILGNLYEVKSKKHP*IIKG | 96. and 966 |
| ATRGLMNLLRSYFRVNNLDVKVKSINGGFTSFLRRKWKFKKERNKGYKHHAEDALIIAN ADFIFKEWKKLDKAKKVMENQMFEEKQAESMPEIETEQEYKEIFITPHQIKHIKDFKDYK YSHRVDKKPNRKLINDTLYSTRKDDKGNTLIVNNLNGLYDKDNDKLKKLINKSPEKLLMY HHDPQTYQKLKLIMEQYGDEKNPLYKYYEETGNYLTKYSKKDNGPVIKKIKYYGNKLNA HLDITDDYPNSRNKVVKLSLKPYRFDVYLDNGVYKFVTVKNLDVIKKENYYEVNSKCYEE AKKLKKISNQAEFIASFYNNDLIKINGELYRVIGVNNDLLNRIEVNMIDITYREYLENMND KRPPQIIKTIASKTQSIKKYSTDILGNLYEVKSKKHP*IIKG | 97. and 966 |
| ATRGLMNLLRSYFRVNNLDVKVKSINGGFTSFLRRKWKFKKERNKGYKHHAEDALIIAN ADFIFKEWKKLDKAKKVMENQMFEEKQAMSMPEIETEQEYKEIFITPHQIKHIKDFKDY KYSHRVDKKPNRELINDTLYSTRKDDKGNTLIVNNLNGLYDKDNDKLKKLINKSPEKLLM YHHDPQTYQKLKLIMEQYGDEKNPLYKYYEETGNYLTKYSKKDNGPVIKKIKYYGNKLNA HLDITDDYPDSRNKVVKLSLKPYRFDVYLDNGVYKFVTVKNLDVIKKENYYEVNSKCYEE AKKLKKISNQAEFIASFYNNDLIKINGELYRVIGVNNDLLNRIEVNMIDITYREYLENMND KRPPHIIKTIASKTQSIKKYSTDILGNLYEVKSQKHPQIIKG | 98. and 966 |
| ATRGLMNLLRSYFRVNNLDVKVKSINGGFTSFLRRKWKFKKERNKGYKHHAEDALIIAN ADFIFKEWKKLDKAKKVMENQMFEEKQAGSMPEIETEQEYKEIFITPHQIKHIKDFKDYK YSHRVDKKPNRKLINDTLYSTRKDDKGNTLIVNNLRLYDKDNDKLKKLINKSPEKLLMYH HDPQTYQKLKLIMEQYGDEKNPLYKYYEETGNYLTKYSKKDNGPVIKKIKYYGNKLNA HLDITDDYPNSRNKVVKLSLKPYRFDVYLDNGVYKFVTVKNLDVIKKENYYEVNSKCYEE AKKLKKISNQAEFIASFYNNDLIKINGELYRVIGVNNDLLNRIEVNMIDITYREYLESMNDK RPPQIIKTIASKTQTIKKYSTDILGNLYEVKSKKHPQIIKKG | 99. |
| ATRGLMNLLRSYYRVNNLDVKVKSINGGFTSFLRRKWKFKKERNKGYKHHAEDALIIAN ADFIFKEWKKLDKAKKVMENQMFEEKQAESMPEIETEQEYKEIFITPHQIKHIKDFKDYK YSHRVDKKPNRELINDTLYSTRKDDKGNTLIVNNLNGLYDKDNDKLKKLTNKSPGKLLM YHHDPQTYQKLKLIMEQYGDEKNPLYKYYEETGNYLTKYSKKDNGPVIKKIKYYGNKLNA YLDITDDYPNSRNNVVKLSLKPYRFDVYLDNGVYKFVIVKNLDVIEKENYYEVNSKCYEE AKKLKKISNQAEFIASFYNNDLIKINGELYRVIGVNNDLLNRIEVNMIDITYREYLENMND KRPPHIIKTIASKTQSIKKYSTDILGNLYEVKSKKHPQIIKKG | 100. |
| ATRGLMNLLRSYFRVNNLDVKVKSINGGFTSFLRRKWKFKKERNKGYKHHAEDALIIAN ADFIFKEWKKLDKAKKVMENQMFEEKQAESMPEIETEQEYKEIFITPHQIKHIKDFKDYK YSHRVDKKPNRLINDTLYSTRKDDKGNTLIVNNLNGLYDKDNDKFKKLINKSPEKLLMY HHDPQTYQKLKLIMEQYGDEKNPLYKYYEETGNYLTKYSKKDNGPVIKKIKYYGNKLNA HLDITDDYPNSRNKVVKLSLKPYRFDVYLDNGVYKFVIVKNLDVIKKDNYYEVNSKCYEE AKKLKKISNQAEFIASFYNNDLIKINGELYRVIGVNNDLLNRIEVNMIDITYREYLENMND KRPPQIIKTIATKTQSIKKYSTDILGNLYEVKSKKHPQIIKKG | 101. |
| ATRGLMNLLRTYFRVNNLDVKVKSINGGFTSFLRRKWKFKKERNKGYKHHAEDALIIAN ADFIFKEWKKLDKAKKVMENQMFEEKHAESMPEIETEQEYKEIFITPHQIKHIKDFKDYK YSHRVDKKPNRELINDTLYSTRKDDKGNTLIVNNLNGLYDKDNDKLKKLIDKSPEKLLMY HHDPQTYQKLKLIMEQYGDEKNPLYKYYEETGNYLTKYSKKDNGPVIKKIKYYGNKLNA HLDITDDYPNSRNKVVKLSLKPYRFDVYLDNGVYKFVTVKNLDVIKKENYYEVNSKCYEE AKKLKKISNQAEFIASFYNNDLIKINGELYRVIGVNNDLLNRIEVNMIDITYREYLENMND KRPPQIIKTIASKTQSIKKYSTDILGNLYEVKSKKHPQIIK*G | 102. |
| ATRGLMNLLRSYFRVNNLDVKVKSINGGFTSFLRRKWKFKKERNKGYKHHAEDALIIAN ADFIFKEWKKLDKAKKVMENQMFEEKQAESMPEIETEQEYNEIFITPHQIKHIKDFKDYK YSHRVDKKPNRKLINDTLYSTRKDDKGNTLIVNNLNGLYDKDNDKLKKLINKSPEKLLMY HHDPQTYQKLKLIMEQYGDEKNPLYKYYEETGNYLTKYSKKDNGPVIKKIKYYGNKLNA HLDITDDYPNSRNKVVKLSLKPYRFDVYLDNGVYKFVTVKNLYVIKKENYYEVNSKCYEE AKKLKKISNQAEFIASFYNNDLIKINGELYRVIGVNNDLLNRIEVNMIDITYREYLENMND KRPPQIIKTIASKTQSIKKYSTDILGNLYEVKSKKHPQIIKKG | 103. |
| ATRGLMNLLRSYFRVNNLDVKVKSINGGFTSFLRRKWKFKKERNKGYKHHAEDALIIAN ADFIFKEWKKLDKAKKVMENQMFEEKQAESMPEIETEQEYKEIFITPHQIKHIKDFKDYK YSHRVDKKPNRLINDTLYSTRKDDKGNTLIVNNLNGLYDKDNDKLKKLINKSPEKLLMY HHDPQTYQKLKLIMEQYGDEKNPLYKYYEETGNYLTKYSKKDNGPVIKKIKYYGNKLNA HLDITDDYPNSRNKVVKLSLKPYRFDVYLDNGVYKFVTVKNLDVIKKENYYEVNSKCYEE AKKLKKISNQAEFIASFYNNDLIKINGELYRVIGVNNDLLNRIEVNMIDITYREYLENMND KRPPQIIKTIASKTQSIKKYSTDILGNLYEVKSKKHPQIIKKG | 104. |

Methods for Example 3

The following materials and methods were used in Example 3.

Plasmids and Oligonucleotides

Oligonucleotides are listed in Table 11, sgRNA target sites are listed in Table 12, and plasmids used in this study are listed in Table 10.

Bacterial Cas9/sgRNA expression plasmids were used to express both a human codon optimized version of SaCas9 and the sgRNA, each expressed under a separate T7 promoter. Bacterial expression plasmids used in the selections were derived from BPK2101 (see Examples 1-2) while those used in the site-depletion assay were modified to express a sgRNA with a shortened repeat:anti-repeat sequence (see below). All sgRNAs in these bacterial expression plasmids included two guanines at the 5' end of the spacer sequence for proper expression from the T7 promoter.

To generate libraries of SaCas9 variants, amino acids M657-G1053 of SaCas9 were randomly mutagenized using Mutazyme II (Agilent Technologies) at a frequency of ~5.5 mutations/kilobase. Both wild-type and R1015Q SaCas9 were used as starting template for mutagenesis, resulting in two libraries with estimated complexities of greater than $6 \times 10^6$ clones.

Positive selection plasmids were assembled by ligating oligonucleotide duplexes encoding target sites into XbarSphI-digested p11-lacY-wtx1 (Chen, Z. & Zhao, H. A highly sensitive selection method for directed evolution of homing endonucleases. Nucleic Acids Res 33, e154 (2005)). For the site-depletion experiments, two separate libraries containing different spacer sequences were generated. For each library, an oligonucleotide containing 8 randomized nucleotides adjacent to the spacer sequence (in place of the PAM) was complexed with a bottom strand primer and filled in using Klenow(–exo) (refer to Table 11). The resulting product was digested with EcoRI and ligated into EcoRI/SphI-digested p11-lacY-wtx1. Estimated complexities of the two site-depletion libraries were greater than $4 \times 10^6$ clones.

For human cell experiments, human codon-optimized wild-type and variant SaCas9s were expressed from a plasmid containing a CAG promoter (Table 12). sgRNA expression plasmids (containing a U6 promoter) were generated by ligating oligonucleotide duplexes encoding the spacer sequence into BsmBI digested VVT1 (See Examples 1-2 or BPK2660 (containing the full length 120 nt crRNA:tracrRNA sgRNA or a 84 nt shortened repeat:anti-repeat version, respectively). All sgRNAs used in this study for human expression included one guanine at the 5' end of the spacer to ensure proper expression from the U6 promoter, and also used a shortened sgRNA (FIG. 37A-B) similar to that previously described (Ran, F. A. et al. In vivo genome editing using *Staphylococcus aureus* Cas9. Nature 520, 186-191 (2015)).

Bioinformatic Analysis of Cas9 Orthologue Sequences

Similar to alignments performed in previous studies (Fonfara, I. et al. Phylogeny of Cas9 determines functional exchangeability of dual-RNA and Cas9 among orthologous type II CRISPR-Cas systems. Nucleic Acids Res 42, 2577-2590 (2014); Ran, F. A. et al. In vivo genome editing using *Staphylococcus aureus* Cas9. Nature 520, 186-191 (2015); Anders, C., Niewoehner, O., Duerst, A. & Jinek, M. Structural basis of PAM-dependent target DNA recognition by the Cas9 endonuclease. Nature 513, 569-573 (2014)), Cas9 orthologues similar to both SpCas9 and SaCas9 were aligned using ClustalW2 (ebi.ac.uk/Tools/msa/clustalw2/). The resulting phylogenetic tree and protein alignment were visualized using Geneious version 8.1.6 and ESPript (espript.ibcp.fr/ESPript/ESPript/).

Bacterial-Based Positive Selection Assay

The bacterial positive selection assays were performed as previously described (See Examples 1-2). Briefly, Cas9/sgRNA plasmids were transformed into *E. coli* BW25141 (λDE3) (Kleinstiver et al., Nucleic Acids Res 38, 2411-2427 (2010)) containing a positive selection plasmid. Transformations were plated on both non-selective (chloramphenicol) and selective (chloramphenicol+10 mM arabinose) conditions. Cas9 cleavage of the selection plasmid was estimated by calculating the percent survival: (# of colonies on selective plates/# of colonies on non-selective plates)× 100. To select for SaCas9 variants capable of recognizing alternative PAMs, the wild-type and R1015Q libraries with mutagenized PI domains were transformed into competent *E. coli* BW25141(λDE3) containing positive selection plasmids with NNAAGT (SEQ ID NO:41), NNAGGT (SEQ ID NO:42), NNCAGT (SEQ ID NO:511), NNCGGT (SEQ ID NO:512), NNTAGT (SEQ ID NO:513), or NNTGGT (SEQ ID NO:514) PAMs. Approximately $1 \times 10^5$ clones were screened by plating on selective conditions, and surviving colonies containing SaCas9 variants presumed to cleave the selection plasmid were mini-prepped (MGH DNA Core). All variants were re-screened individually in the positive selection assay, and those with greater than ~20% survival were sequenced to determine the mutations required for recognition of the alternate PAM.

Bacterial-Based Site-Depletion Assay

The site-depletion experiments were performed as previously described (See Examples 1-2). Briefly, the randomized PAM libraries were electroporated into competent *E. coli* BW25141(λDE3) containing either wild-type, catalytically inactive (D10A/H557A), or KKH variant SaCas9/sgRNA plasmids. Greater than $1 \times 10^5$ colonies were plated on chloramphenicol/carbenicillin plates, and selection plasmids with PAMs resistant to Cas9 targeting contained within the surviving colonies were isolated by maxiprep (Qiagen). The region of the plasmid containing the spacer sequence and PAM was PCR-amplified using the primers listed in Table 11. The KAPA HTP library preparation kit (KAPA BioSystems) was used to generate a dual-indexed Tru-seq Illumina sequencing library using ~500 ng purified PCR product from each site-depletion condition prior to an Illumina MiSeq high-throughput sequencing run at the Dana-Farber Cancer Institute Molecular Biology Core. The data from the site-depletion experiments was analyzed as previously described (See Examples 1-2), with the exception that the script was modified to analyze 8 randomized nucleotides. Cas9 ability to recognize PAMs was determined by calculating the post-selection PAM depletion value (PPDV) of any given PAM: the ratio of the post-selection frequency of that PAM to the pre-selection library frequency. A control experiment using catalytically inactive SaCas9 was used to establish that a PPDV of 0.794 represents statistically significant depletion relative to the input library.

Human Cell Culture and Transfection

U2OS cells obtained from our collaborator T. Cathomen (Freiburg) and U20S.EGFP cells harboring a single integrated copy of an EGFP-PEST reporter gene (Reyon, D. et al. FLASH assembly of TALENs for high-throughput genome editing. Nat Biotechnol 30, 460-465 (2012)) were cultured in Advanced DMEM medium (Life Technologies) with 10% FBS, penicillin/streptomycin, and 2 mM Gluta-MAX (Life Technologies) at 37° C. with 5% $CO_2$. Cell line identities were validated by STR profiling (ATCC) and deep sequencing, and cells were tested bi-weekly for *mycoplasma* contamination. U2OS.EGFP culture medium was additionally supplemented with 400 µg/mL G418. Cells were co-transfected with 750 ng Cas9 plasmid and 250 ng sgRNA plasmid using the DN-100 program of a Lonza 4D-nucleofector following the manufacturer's instructions.

Human Cell EGFP Disruption Assay

EGFP disruption experiments were performed as previously described (Fu, Y. et al. High-frequency off-target mutagenesis induced by CRISPR-Cas nucleases in human cells. Nat Biotechnol 31, 822-826 (2013); Reyon, D. et al. FLASH assembly of TALENs for high-throughput genome editing. Nat Biotechnol 30, 460-465 (2012)). Approximately 52 hours post-transfection, a Fortessa flow cytometer (BD Biosciences) was used to measure EGFP fluorescence in transfected U2OS.EGFP cells. Negative control transfections of Cas9 and empty U6 promoter plasmids were used to establish background EGFP loss at ~2.5% for all experiments (represented as a red dashed lined in FIGs).

T7E1 Assay

T7E1 assays were performed as previously described (Reyon, D. et al. FLASH assembly of TALENs for high-throughput genome editing. Nat Biotechnol 30, 460-465 (2012)) to quantify Cas9-induced mutagenesis at endogenous loci in human cells. Approximately 72 hours post-transfection, genomic DNA was isolated using the Agencourt DNAdvance Genomic DNA Isolation Kit (Beckman Coulter Genomics). Target loci were PCR-amplified from ~100 ng of genomic DNA using the primers listed in Table 11. Following an Agencourt Ampure XP clean-up step (Beckman Coulter Genomics), ~200 ng purified PCR product was denatured and hybridized prior to digestion with T7E1 (New England Biolabs). Following a second clean-up step, mutagenesis frequencies were quantified using a Qiaxcel capillary electrophoresis instrument (Qiagen).

GUIDE-Seq Experiments

GUIDE-seq experiments were performed and analyzed as previously described (Tsai, S. Q. et al. GUIDE-seq enables genome-wide profiling of off-target cleavage by CRISPR-Cas nucleases. Nat Biotechnol 33, 187-197 (2015)). Briefly, U2OS cells were transfected as described above with Cas9 and sgRNA plasmids, as well as 100 pmol of a phosphorylated, phosphorothioate-modified double-stranded oligodeoxynucleotide (dsODN) with an embedded NdeI site. Restriction fragment length polymorphism (RFLP) analyses were performed to determine frequency of dsODN-tag integration frequencies ((See Examples 1-2; Tsai, S. Q. et al. GUIDE-seq enables genome-wide profiling of off-target cleavage by CRISPR-Cas nucleases. Nat Biotechnol 33, 187-197 (2015)), and T7E1 assays were performed to quantify on-target Cas9 mutagenesis frequencies. dsODN tag-specific amplification and library preparation (Tsai, S. Q. et al. GUIDE-seq enables genome-wide profiling of off-target cleavage by CRISPR-Cas nucleases. Nat Biotechnol 33, 187-197 (2015)) was performed prior to high-throughput sequencing using an Illumina MiSeq Sequencer. When mapping potential off-target sites, the cut-off for alignment to the on-target spacer sequence was set at 8 mismatches for 21 nucleotide spacers, 9 mismatches for 22 nucleotide spacers, and 10 mismatches for 23 nucleotide spacers. Off-target sites with potential DNA- or RNA-bulges (Lin, Y. et al. CRISPR/Cas9 systems have off-target activity with insertions or deletions between target DNA and guide RNA sequences. Nucleic Acids Res 42, 7473-7485 (2014)) were identified by manual alignment.

TABLE 10

Plasmids used in Example 3

| Name | SEQ ID NO: | Description |
|---|---|---|
| BPK2101 | 10 | T7-humanSaCas9-NLS-3xFLAG-T7-BsaIcassette-Sa-sgRNA(120) Addgene ID: 65770 T7 promoters at 1-17 and 3418-3434, human codon optimized *S. aureus* Cas9 at 88-3352, NLS at 3256-3276, 3xFLAG tag at 3283-3348, BsaI sites at 3437-3442 and 3485-3490, gRNA at 3492-3616, T7 terminator at 3627-2674 of SEQ ID NO: 10. |
| MSP2283 | 21 | T7-humanSaCas9-NLS-3xFLAG-T7-site1-Sa-sgRNA(84) T7 promoters at nts 1-17 and 3418-3434, human codon optimized *S. aureus* Cas9 at 88-3351, NLS at 3256-3276, 3xFLAG tag at 3243-33348, site 1 spacer at 3435-3455, sgRNA(84) at 3456-3539, T7 terminator at 3562-3609 of SEQ ID NO: 21 |
| MSP2262 | 22 | T7-humanSadCas9(D10A, H557A)-NLS-3xFLAG-T7-site1-Sa-sgRNA(84) T7 promoters at nts 1-17 and 3418-3434, human codon optimized *S. aureus* Cas9 at 88-3351, modified codons at 118-120 and 1759-1761, NLS at 3256-3276, 3xFLAG tag at 3243-33348, site 1 spacer at 3435-3455, sgRNA(84) at 3456-3539, T7 terminator at 3562-3609 of SEQ ID NO: 22 |
| MSP2253 | 23 | T7-humanSaCas9(E782K, N968K, R1015H)-NLS-3xFLAG-T7-site1-Sa-sgRNA(84) T7 promoters at nts 1-17 and 3418-3434, human codon optimized *S. aureus* Cas9 at 88-3351, modified codons at 2434-2436, 2992-2994, and 3133-3135, NLS at 3256-3276, 3xFLAG tag at 3243-33348, site 1 spacer at 3435-3455, sgRNA(84) at 3456-3539, T7 terminator at 3562-3609 of SEQ ID NO: 23 |
| MSP2266 | 24 | T7-humanSaCas9-NLS-3xFLAG-T7-site2-Sa-sgRNA(84) T7 promoters at 1-17 and 3419-3434, human codon optimized *S. aureus* Cas9 at 88-3351, NLS at 3256-3276, 3xFLAG tag at 3283-3348, site 2 spacer at 3435-3455, sgRNA(84) at 3456-3539, T7 terminator at 3562-3609 of SEQ ID NO: 24 |
| MSP2279 | 25 | T7-humanSadCas9(D10A, H557A)-NLS-3xFLAG-T7-site2-Sa-sgRNA(84) T7 promoters at 1-17 and 3419-3434, human codon optimized *S. aureus* Cas9 at 88-3351, modified codons at 118-120 and 1759-1761, NLS at 3256-3276, 3xFLAG tag at 3283-3348, site 2 spacer at 3435-3455, sgRNA(84) at 3456-3539, T7 terminator at 3562-3609 of SEQ ID NO: 25 |
| MSP2292 | 26 | T7-humanSaCas9(E782K, N968K, R1015H)-NLS-3xFLAG-T7-site2-Sa-sgRNA(84) T7 promoters at 1-17 and 3419-3434, human codon optimized *S. aureus* Cas9 at 88-3351, modified codons at 2434-2436, 2992-2994, and 3133-3135, NLS at 3256-3276, 3xFLAG tag at 3283-3348, site 2 spacer at 3435-3455, sgRNA(84) at 3456-3539, T7 terminator at 3562-3609 of SEQ ID NO: 26 |
| p11-lacY-wtx1 | — | BAD-ccDB-Amp$^R$-AraC-lacY(A177C) (Chen et al, 2005) |
| BPK2139 | 17 | CAG-humanSaCas9-NLS-3xFLAG Addgene ID: 65776 Human codon optimized *S. aureus* Cas9 1-3195, NLS 3169-3189, 3xFLAG tag 3196-3261 of SEQ ID NO: 17. |
| MSP1830 | 27 | CAG-humanSaCas9(E782K, N968K, R1015H)-3xFLAG (KKH variant) Human codon optimized *S. aureus* Cas9 1-3264, NLS 3169-3189, modified codons at 2347-2349, 2905-2907, and 3046-3048, 3xFLAG tag 3196-3261 of SEQ ID NO: 27 |
| VVT1 | 20 | U6-BsmBIcassette-Sa-sgRNA(120) Addgene ID: 65779 U6 promoter 1-318, BsmBI sites at 320-325 and 333-338, |

TABLE 10-continued

Plasmids used in Example 3

| Name | SEQ ID NO: | Description |
|---|---|---|
| BPK2660 | 28 | S. aureus gRNA 340-466, U6 terminator 459-466 of SEQ ID NO: 20. U6-BsmBIcassette-Sa-sgRNA(84) U6 promoter 1-318, BsmBI sites at 320-325 and 333-338, S. aureus gRNA 340-423, U6 terminator 424-430 of SEQ ID NO: 28. |

TABLE 11

Oligonucleotides used in Example 3

| Sequence | Description | SEQ ID NO: |
|---|---|---|
| *Oligos used to generate positive selection plasmids* | | |
| ctagaGGGtGGGcGGGaGGGTCGCCCTCGAACTTCACCTtgGAGTgcatg | top oligo to clone site 2 with an NNGAGT (SEQ ID NO: 5) PAM into the positive selection vector (XbaI/SphI cut p11-lacY-wtx1) | 515 |
| cACTCcaAGGTGAAGTTCGAGGGCGACCCtCCCgCCCaCCCt | bottom oligo to clone site 2 into the positive selection vector | 516 |
| *Oligos used to generate libraries for site-depletion experiments* | | |
| GCAGgaattcGGGAGGGGCACGGGCAGCTTGCCGGNNNNNNNNNCTNNNGCGCAGGTCACGAGGCATG | top strand oligo for site 1 PAM library, cut with EcoRI once filled in | 517 |
| GCAGgaattcGGAGGGTCGCCCTCGAACTTCACCTNNNNNNNNNCTNNNGCGCAGGTCACGAGGCATG | top strand oligo for site 2 PAM library, cut with EcoRI once filled in | 518 |
| /5Phos/CCTCGTGACCTGCGC | reverse primer to fill in library oligos | 200 |
| *Primers used to amplify site-depletion libraries for sequencing* | | |
| GATACCGCTCGCCGCAGC | forward primer | 201 |
| CTGCGTTCTGATTTAATCTGTATCAGGC | reverse primer | 202 |
| *Primers used for T7E1 and RFLP experiments* | | |
| GGAGCAGCTGGTCAGAGGGG | forward primer targeted to EMX1 in U2OS human cells | 209 |
| CCATAGGGAAGGGGACACTGG | reverse primer targeted to EMX1 in U2OS human cells | 210 |
| GGGCCGGGAAAGAGTTGCTG | forward primer targeted to FANCF in U2OS human cells | 211 |
| GCCCTACATCTGCTCTCCCTCC | reverse primer targeted to FANCF in U2OS human cells | 212 |
| CCAGCACAACTTACTCGCACTTGAC | forward primer targeted to RUNX1 in U2OS human cells | 213 |
| CATCACCAACCCACAGCCAAGG | reverse primer targeted to RUNX1 in U2OS human cells | 214 |
| TCCAGATGGCACATTGTCAG | forward primer targeted to VEGFA in U2OS human cells | 652 |
| AGGGAGCAGGAAAGTGAGGT | reverse primer targeted to VEGFA in U2OS human cells | 653 |

TABLE 12 sgRNA target sites for Example 3

In VVT1 (120)
EGFP

| Prep Name | Name | Spacer length (nt) | Spacer Sequence | SEQ ID NO:: | Sequence with PAM | SEQ ID NO: |
|---|---|---|---|---|---|---|
| MSP1428 | NNGRRT 1 (SEQ ID NO: 46) | 21 | GCCCTCGAACTTCACCTCGGC | 405 | GCCCTCGAACTTCACCTCGGCGCGGGT | 406 |
| MSP1400 | NNGRRT 2 (SEQ ID NO: 46) | 21 | GCAACATCCTGGGGCACAAGC | 397 | GCAACATCCTGGGGCACAAGCTGGAGT | 398 |
| MSP1401 | NNGRRT 3 (SEQ ID NO: 46) | 21 | GTTGTACTCCAGCTTGTGCCC | 519 | GTTGTACTCCAGCTTGTGCCCCAGGAT | 520 |
| MSP1403 | NNGRRT 4 (SEQ ID NO: 46) | 22 | GCAAGGGCGAGGAGCTGTTCAC | 409 | GCAAGGGCGAGGAGCTGTTCACCGGGGT | 410 |
| MSP1748 | NNARRT 1 (SEQ ID NO: 43) | 20 | GGACGGCGACGTAAACGGCC | 521 | GGACGGCGACGTAAACGGCCACAAGT | 522 |
| MSP1754 | NNARRT 5 (SEQ ID NO: 43) | 21 | GAACTTCAGGGTCAGCTTGCC | 523 | GAACTTCAGGGTCAGCTTGCCGTAGGT | 524 |
| MSP2030 | NNCRRT 2 (SEQ ID NO: 47) | 20 | GTCGATGCCCTTCAGCTCGA | 525 | GTCGATGCCCTTCAGCTCGATGCGGT | 526 |
| MSP2034 | NNCRRT 4 (SEQ ID NO: 47) | 22 | GTGACCACCCTGACCTACGGCG | 527 | GTGACCACCCTGACCTACGGCGTGCAGT | 528 |
| MSP2040 | NNTRRT 1 (SEQ ID NO: 48) | 20 | GATATAGACGTTGTGGCTGT | 529 | GATATAGACGTTGTGGCTGTTGTAGT | 530 |
| MSP2045 | NNTRRT 3 (SEQ ID NO: 48) | 21 | GGTGAAGTTCGAGGGCGACAC | 531 | GGTGAAGTTCGAGGGCGACACCCTGGT | 532 |

In BPK2660 (84)
EGFP

| Prep Name | Name | Spacer length (nt) | Spacer Sequence | | Sequence with PAM | |
|---|---|---|---|---|---|---|
| MSP2149* | NNARRT 1 (SEQ ID NO: 43) | 20 | GGACGGCGACGTAAACGGCC | 521 | GGACGGCGACGTAAACGGCCACAAGT | 522 |
| MSP2152 | NNARRT 2 (SEQ ID NO: 43) | 21 | GTAGTTGCCGTCGTCCTTGAA | 654 | GTAGTTGCCGTCGTCCTTGAAGAAGAT | 655 |
| MSP2153 | NNARRT 3 (SEQ ID NO: 43) | 22 | GCCACCTACGGCAAGCTGACCC | 656 | GCCACCTACGGCAAGCTGACCCTGAAGT | 657 |
| MSP2154 | NNARRT 4 (SEQ ID NO: 43) | 23 | DACGGCAACTACAAGACCCGCGC | 658 | DACGGCAACTACAAGACCCGCGCCGAGGT | 659 |
| MSP2150* | NNARRT 5 (SEQ ID NO: 43) | 21 | GAACTTCAGGGTCAGCTTGCC | 523 | GAACTTCAGGGTCAGCTTGCCGTAGGT | 524 |
| MSP2155 | NNCRRT 1 (SEQ ID NO: 47) | 20 | GCGTGTCCGGCGAGGGCGAG | 305 | GCGTGTCCGGCGAGGGCGAGGGCGAT | 533 |
| MSP2156* | NNCRRT 2 (SEQ ID NO: 47) | 20 | GTCGATGCCCTTCAGCTCGA | 525 | GTCGATGCCCTTCAGCTCGATGCGGT | 526 |
| MSP2158 | NNCRRT 3 (SEQ ID NO: 47) | 22 | GCTCGACCAGGATGGGCACCAC | 534 | GCTCGACCAGGATGGGCACCACCCCGGT | 535 |
| MSP2159* | NNCRRT 4 (SEQ ID NO: 47) | 22 | GTGACCACCCTGACCTACGGCG | 527 | GTGACCACCCTGACCTACGGCGTGCAGT | 528 |
| MSP2145* | NNGRRT 1 (SEQ ID NO: 46) | 21 | GCCCTCGAACTTCACCTCGGC | 405 | GCCCTCGAACTTCACCTCGGCGCGGGT | 406 |

TABLE 12-continued sgRNA target sites for Example 3

| Prep Name | Name | Spacer length (nt) | Spacer Sequence | | Sequence with PAM | |
|---|---|---|---|---|---|---|
| MSP2146* | NNGRRT 2 (SEQ ID NO: 46) | 21 | GCAACATCCTGGGGCACAAGC | 397 | GCAACATCCTGGGGCACAAGCTGGAGT | 398 |
| MSP2147 | NNGRRT 3 (SEQ ID NO: 46) | 21 | GTTGTACTCCAGCTTGTGCCC | 519 | GTTGTACTCCAGCTTGTGCCCCAGGAT | 520 |
| MSP2148 | NNGRRT 4 (SEQ ID NO: 46) | 22 | GCAAGGGCGAGGAGCTGTTCAC | 409 | GCAAGGGCGAGGAGCTGTTCACCGGGGT | 410 |
| MSP2161* | NNTRRT 1 (SEQ ID NO: 48) | 20 | GATATAGACGTTGTGGCTGT | 529 | GATATAGACGTTGTGGCTGTTGTAGT | 530 |
| MSP2162 | NNTRRT 2 (SEQ ID NO: 48) | 21 | GGGCGAGGAGCTGTTCACCGG | 536 | GGGCGAGGAGCTGTTCACCGGGGTGGT | 537 |
| MSP2164* | NNTRRT 3 (SEQ ID NO: 48) | 21 | GGTGAAGTTCGAGGGCGACAC | 531 | GGTGAAGTTCGAGGGCGACACCCTGGT | 532 |
| MSP2163 | NNTRRT 4 (SEQ ID NO: 48) | 21 | GCACTGCACGCCGTAGGTCAG | 538 | GCACTGCACGCCGTAGGTCAGGGTGGT | 539 |

Endogenous genes

EMX1

| Prep Name | Name | Spacer length (nt) | Spacer Sequence | | Sequence with PAM | |
|---|---|---|---|---|---|---|
| MSP2184** | EMX1 1 | 22 | GTGTGGTTCCAGAACCGGAGGA | 540 | GTGTGGTTCCAGAACCGGAGGACAAAGT | 541 |
| MSP2185 | EMX1 2 | 21 | GCAGGCTCTCCGAGGAGAAGG | 542 | GCAGGCTCTCCGAGGAGAAGGCCAAGT | 543 |
| MSP2183 | EMX1 3 | 23 | GCCCCTCCCTCCCTGGCCCAGGT | 544 | GCCCCTCCCTCCCTGGCCCAGGTGAAGGT | 545 |
| MSP2199** | EMX1 4 | 21 | GCTCAGCCTGAGTGTTGAGGC | 546 | GCTCAGCCTGAGTGTTGAGGCCCCAGT | 547 |
| MSP2202 | EMX1 5 | 21 | GCCTGCTTCGTGGCAATGCGCC | 548 | GCCTGCTTCGTGGCAATGCGCCACCGGT | 549 |
| MSP2168** | EMX1 6 | 21 | GCAACCACAAACCCACGAGGG | 550 | GCAACCACAAACCCACGAGGGCAGGT | 551 |
| MSP2169 | EMX1 7 | 21 | GGCCTCCCCAAAGCCTGGCCA | 552 | GGCCTCCCCAAAGCCTGGCCAGGGAGT | 553 |
| MSP2170 | EMX1 8 | 23 | GCAGAAGCTGGAGGAGGAAGGGC | 554 | GCAGAAGCTGGAGGAGGAAGGGCCTGAGT | 555 |
| MSP2201 | EMX1 9 | 21 | GCTTCGTGGCAATGCGCCACCG | 556 | GCTTCGTGGCAATGCGCCACCGGTTGAT | 557 |
| MSP2200** | EMX1 10 | 22 | GGCTCTCCGAGGAGAAGGCCA | 558 | GGCTCTCCGAGGAGAAGGCCAAGTGGT | 559 |

FANCF

| Prep Name | Name | Spacer length (nt) | Spacer Sequence | | Sequence with PAM | |
|---|---|---|---|---|---|---|
| MSP2189 | FANCF 1 | 22 | GCCTCTCTGCAATGCTATTGGT | 560 | GCCTCTCTGCAATGCTATTGGTCGAAAT | 561 |
| MSP2190 | FANCF 2 | 21 | GCGTACTGATTGGAACATCCG | 562 | GCGTACTGATTGGAACATCCGCGAAAT | 563 |
| MSP2186 | FANCF 3 | 23 | GACGTCACAGTGACCGAGGGCCT | 564 | GACGTCACAGTGACCGAGGGCCTGGAAGT | 565 |
| MSP2187 | FANCF 4 | 23 | GCCCGGCGCACGGTGGCGGGGTC | 566 | GCCCGGCGCACGGTGGCGGGGTCCCAGGT | 567 |
| MSP2188 | FANCF 5 | 21 | GGCGGGGTCCCAGGTGCTGAC | 568 | GGCGGGGTCCCAGGTGCTGACGTAGGT | 569 |
| MSP2205 | FANCF 6 | 21 | GGCGTATCATTTCGCGGATGT | 570 | GGCGTATCATTTCGCGGATGTTCCAAT | 571 |
| MSP2208 | FANCF 7 | 22 | GAGACCGCCAGAAGCTCGGAAA | 572 | GAGACCGCCAGAAGCTCGGAAAAGCGAT | 573 |
| MSP2204 | FANCF 8 | 21 | GGATCGCTTTTCCGAGCTTCT | 574 | GGATCGCTTTTCCGAGCTTCTGGCGGT | 575 |
| MSP2207** | FANCF 9 | 22 | GCGCCCACTGCAAGGCCCGGCG | 576 | GCGCCCACTGCAAGGCCCGGCGCACGGT | 577 |
| MSP2172** | FANCF 10 | 21 | GTAGGGCCTTCGCGCACCTCA | 578 | GTAGGGCCTTCGCGCACCTCATGGAAT | 579 |
| MSP2174 | FANCF 11 | 22 | GCAGCCGCCGCTCCAGAGCCGT | 580 | GCAGCCGCCGCTCCAGAGCCGTGCGAAT | 581 |
| MSP2332 | FANCF 12 | 22 | GGCCATGCCGACCAAAGCGCCG | 582 | GGCCATGCCGACCAAAGCGCCGATGGAT | 583 |
| MSP2171** | FANCF 13 | 21 | GCAAGGCCCGGCGCACGGTGG | 584 | GCAAGGCCCGGCGCACGGTGGCGGGGT | 585 |
| MSP2173 | FANCF 14 | 22 | GAGGCAAGAGGGCGGCTTTGGG | 586 | GAGGCAAGAGGGCGGCTTTGGGCGGGGT | 587 |
| MSP2206 | FANCF 15 | 22 | GTGACCGAGGGCCTGGAAGTTC | 588 | GTGACCGAGGGCCTGGAAGTTCGCTAAT | 589 |
| MSP2203** | FANCF 16 | 21 | GGGGTCCCAGGTGCTGACGTA | 590 | GGGGTCCCAGGTGCTGACGTAGGTAGT | 591 |
| MSP2209 | FANCF 17 | 22 | GTACTGATTGGAACATCCGCGA | 592 | GTACTGATTGGAACATCCGCGAAATGAT | 593 |

RUNX1

| Prep Name | Name | Spacer length (nt) | Spacer Sequence | | Sequence with PAM | |
|---|---|---|---|---|---|---|
| MSP2192 | RUNX1 1 | 23 | GTCTGAAGCCATCGCTTCCTCCT | 594 | GTCTGAAGCCATCGCTTCCTCCTGAAAAT | 595 |
| MSP2193 | RUNX1 2 | 21 | GGTTTTCGCTCCGAAGGTAAA | 596 | GGTTTTCGCTCCGAAGGTAAAAGAAAT | 597 |
| MSP2195 | RUNX1 3 | 21 | GGGACTCCCCAAGCCCTATTA | 598 | GGGACTCCCCAAGCCCTATTAAAAAAT | 599 |
| MSP2235 | RUNX1 4 | 22 | GCAGCTTGTTTCACCTCGGTGC | 600 | GCAGCTTGTTTCACCTCGGTGCAGAGAT | 601 |
| MSP2194 | RUNX1 5 | 22 | GACCTGTCTTGGTTTTCGCTCC | 602 | GACCTGTCTTGGTTTTCGCTCCGAAGGT | 603 |
| MSP2216 | RUNX1 6 | 23 | GCTTCCATCTGATTAGTAAGTAA | 604 | GCTTCCATCTGATTAGTAAGTAATCCAAT | 605 |
| MSP2214 | RUNX1 7 | 22 | GTGCAGAGATGCCTCGGTGCCT | 606 | GTGCAGAGATGCCTCGGTGCCTGCCAGT | 607 |

TABLE 12-continued sgRNA target sites for Example 3

| Prep Name | Name | Spacer length (nt) | Spacer Sequence | Sequence with PAM | |
|---|---|---|---|---|---|
| MSP2211 | RUNX1 8 | 21 | GAGGGTGCATTTTCAGGAGGA | 608. GAGGGTGCATTTTCAGGAGGAAGCGAT | 609. |
| MSP2217 | RUNX1 9 | 23 | GTTTCACCTCGGTGCAGAGATGC | 610. GTTTCACCTCGGTGCAGAGATGCCTCGGT | 611. |
| MSP2176 | RUNX1 10 | 22 | GCGATGGCTTCAGACAGCATAT | 612. GCGATGGCTTCAGACAGCATATTTGAGT | 613. |
| MSP2177 | RUNX1 11 | 22 | GCTCCGAAGGTAAAAGAAATCA | 614. GCTCCGAAGGTAAAAGAAATCATTGAGT | 615. |
| MSP2334 | RUNX1 12 | 22 | GAGGCATATGATTACAAGTCTA | 616. GAGGCATATGATTACAAGTCTATTGGAT | 617. |
| MSP2175** | RUNX1 13 | 21 | GAAAGAGAGATGTAGGGCTAG | 618. GAAAGAGAGATGTAGGGCTAGAGGGGT | 619. |
| MSP2178** | RUNX1 14 | 23 | GTACTCACCTCTCATGAAGCACT | 620. GTACTCACCTCTCATGAAGCACTGTGGGT | 621. |
| MSP2210 | RUNX1 15 | 21 | GAGGTGAGTACATGCTGGTCT | 622. GAGGTGAGTACATGCTGGTCTTGTAAT | 623. |
| MSP2213 | RUNX1 16 | 22 | GAGAGGAATTCAAACTGAGGCA | 624. GAGAGGAATTCAAACTGAGGCATATGAT | 625. |
| MSP2212 | RUNX1 17 | 21 | GAGGCTGAAACAGTGACCTGT | 626. GAGGCTGAAACAGTGACCTGTCTTGGT | 627. |

| | | | VEGFA | | |
|---|---|---|---|---|---|
| Prep Name | Name | Spacer length (nt) | Spacer Sequence | Sequence with PAM | |
| MSP2196 | VEGFA 1 | 21 | GTACATGAAGCAACTCCAGTC | 628. GTACATGAAGCAACTCCAGTCCCAAAT | 629. |
| MSP2198 | VEGFA 2 | 21 | GACGGGTGGGGAGAGGGACAC | 630. GACGGGTGGGGAGAGGGACACACAGAT | 631. |
| MSP2197 | VEGFA 3 | 22 | GTCCCAAATATGTAGCTGTTTG | 632. GTCCCAAATATGTAGCTGTTTGGGAGGT | 633. |
| MSP2219 | VEGFA 4 | 21 | GGCCAGGGGTCACTCCAGGAT | 634. GGCCAGGGGTCACTCCAGGATTCCAAT | 635. |
| MSP2220 | VEGFA 5 | 22 | GCCAGAGCCGGGGTGTGCAGAC | 636. GCCAGAGCCGGGGTGTGCAGACGGCAGT | 637. |
| MSP2181 | VEGFA 6 | 22 | GAGGACGTGTGTGTCTGTGTGG | 638. GAGGACGTGTGTGTCTGTGTGGGTGAGT | 639. |
| MSP2336 | VEGFA 7 | 22 | GGGAGAAGGCCAGGGGTCACTC | 640. GGGAGAAGGCCAGGGGTCACTCCAGGAT | 641. |
| MSP2179** | VEGFA 8 | 21 | GGGTGAGTGAGTGTGTGCGTG | 642. GGGTGAGTGAGTGTGTGCGTGTGGGGT | 643. |
| MSP2180 | VEGFA 9 | 22 | GAGTGAGGACGTGTGTCTGT | 644. GAGTGAGGACGTGTGTGTCTGTGTGGGT | 645. |
| MSP2182 | VEGFA 10 | 22 | GCGTTGGAGCGGGGAGAAGGCC | 646. GCGTTGGAGCGGGGAGAAGGCCAGGGGT | 647. |
| MSP2218 | VEGFA 11 | 21 | GCTCCATTCACCCAGCTTCCC | 648. GCTCCATTCACCCAGCTTCCCTGTGGT | 649. |

*Used in FIGS. 1C and 1E, FIG. 32
**Used for GUIDE-seq experiments in FIG. 3, FIGS. 36A-B Example 3

Engineering the PAM Specificity of *Staphylococcus aureus* Cas9

Site-specific DNA cleavage by CRISPR-Cas9 nucleases is primarily guided by RNA-DNA interactions, but also requires Cas9-mediated recognition of a protospacer adjacent motif (PAM). Although the commonly used *Streptococcus pyogenes* Cas9 specifies only two nucleotides within its NGG PAM, other Cas9 orthologues with desirable properties recognize longer PAMs. While potentially advantageous from the perspective of specificity, extended PAM sequences can limit the targeting range of Cas9 orthologues for genome editing applications. One possible strategy to broaden the range of sequences targetable by such Cas9 orthologues might be to evolve variants with relaxed specificity for certain positions within the PAM. Here we used molecular evolution to modify the NNGRRT (SEQ ID NO:46) PAM specificity of *Staphylococcus aureus* Cas9 (SaCas9), a smaller size orthologue that is useful for applications requiring viral delivery. One variant we identified, referred to as KKH SaCas9, shows robust genome editing activities at endogenous human target sites with NNNRRT PAMs. Importantly, using the GUIDE-seq method, we showed that both wild-type and KKH SaCas9 induce comparable numbers of off-target effects in human cells. KKH SaCas9 increased the targeting range of SaCas9 by nearly two- to four-fold, enabling targeting of sequences that cannot be altered with the wild-type nuclease. More generally, these results demonstrate the feasibility of relaxing PAM specificity to broaden the targeting range of Cas9 orthologues. Our molecular evolution strategy does not require structural information or a priori knowledge of specific residues that contact the PAM, and therefore should be applicable to a wide range of Cas9 orthologues.

Results

We devised an unbiased genetic approach for engineering Cas9 variants with relaxed PAM recognition specificities that does not require structural information. We tested this strategy using SaCas9, for which no structural data was available at the time we initiated these studies. In an initial step, we sought to conservatively estimate the PAM-interacting domain for SaCas9 by sequence comparisons with the structurally well-characterized SpCas9 (Jiang et al., Science 348, 1477-1481 (2015); Anders et al., Nature 513, 569-573 (2014); Jinek et al., Science (2014); Nishimasu et al., Cell (2014)). Although SpCas9 and SaCas9 differ substantially at the primary sequence level (FIG. 21A, FIG. 29), alignment of both with 10 additional orthologues enabled us to conservatively define a predicted PAM-interacting domain for SaCas9 (See Methods for Example 3; FIGS. 29 and 30).

Because the guanine at the third position in the SaCas9 PAM is the most strictly specified base (Ran et al., Nature 520, 186-191 (2015)), we randomly mutagenized the predicted PI domain and used our previously described bacterial cell-based method (see Examples 1-2) to attempt to select for mutants capable of cleaving sites with each of the three other possible nucleotides at the 3rd PAM position (i.e., NN[A/C/T]RRT PAMs (NNHRRT (SEQ ID NO:44)); FIG. 31A). All but one of the surviving variants from the selections against sites containing NNARRT (SEQ ID NO:43) and NNCRRT (SEQ ID NO:47) PAMs harbored an R1015H mutation, whereas we did not obtain any variants from the selections with NNTRRT (SEQ ID NO:48) PAMs. These results strongly suggested that R1015 might participate in recognition of the guanine at the third position of the SpCas9 PAM. Indeed, in our alignments we found that R1015 of SaCas9 is in the vicinity of SpCas9 R1335 (FIG. 30), a residue previously implicated in recognition of the third base position of the PAM ((See Examples 1-2; Anders, C., Niewoehner, O., Duerst, A. & Jinek, M. Structural basis of PAM-dependent target DNA recognition by the Cas9 endonuclease. Nature 513, 569-573 (2014)). Consistent with this, we found that mutation of R1015 to an alanine or glutamine substantially decreased SaCas9 activity on a target site containing an NNGRRT (SEQ ID NO:46) PAM (FIG. 21B) when tested in our bacterial selection system (FIG. 31B). Alanine or glutamine substitutions of other positively charged residues in the vicinity of R1015 did not have as strong of an effect on SaCas9 activity (FIG. 21B, FIG. 30).

Our bacterial-based selection results also suggested that the R1015H mutation might at least partially relax the specificity of SaCas9 at the third position of the PAM. However, we found that the R1015H single mutant had suboptimal activity in our previously described human cell-based EGFP disruption assay (Fu et al., Nat Biotechnol 31, 822-826 (2013); Reyon et al., Nat Biotechnol 30, 460-465 (2012)) when tested against sites with any nucleotide at the 3rd position of NNNRRT PAMs (FIG. 21C). Because this suggested that additional mutations might be required to increase or optimize the activity of the R1015H mutant in human cells, we randomly mutagenized a region encompassing the predicted PI domain of an SaCas9 that also harbored a R1015Q mutation. We then selected for variants from this library that could cleave target sites with each of the three different NNHRRT (SEQ ID NO:44) PAMs using our bacterial selection system. We used R1015Q because, unlike R1015H, this mutant did not show activity in bacteria (FIG. 21B). Although no surviving clones were again observed when selecting against NNTRRT (SEQ ID NO:48) PAMs, selections with the R1015Q variant against NNARRT (SEQ ID NO:43) or NNCRRT (SEQ ID NO:47) yielded mutations at E782, K929, N968, and, surprisingly, mutation of the Q at 1015 to H.

Figure 21D:
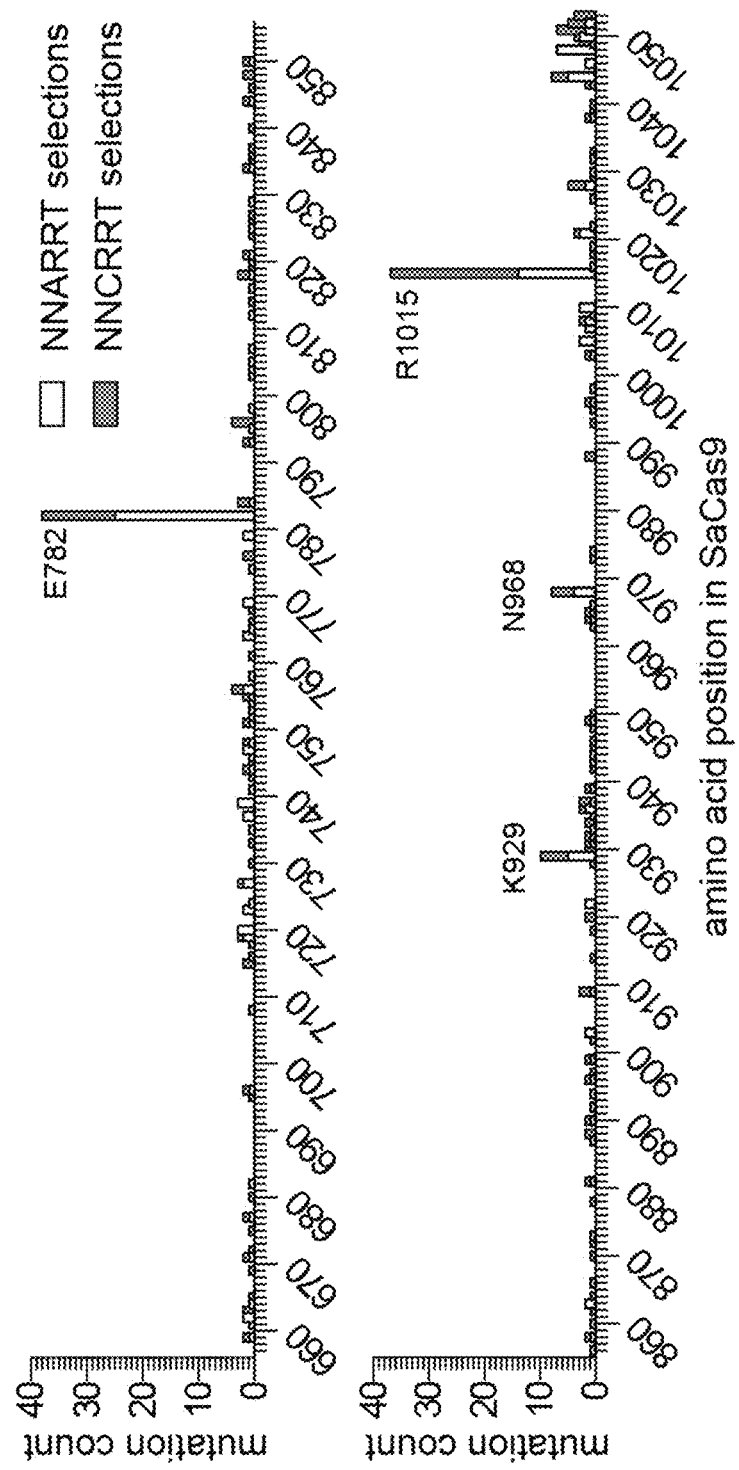
Figure 21E:
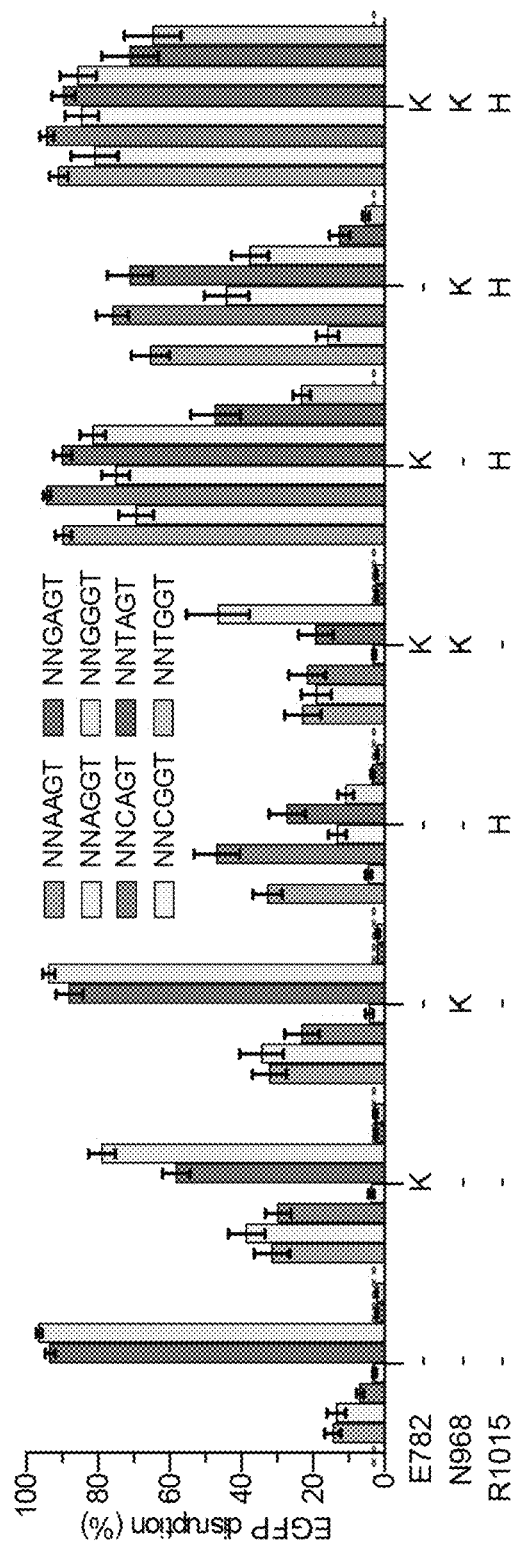

Combined with the selection results from wild-type SaCas9, the most frequent missense mutations identified across all selections were E782K, K929R, N968K, and R1015H (FIG. 21D), suggesting that a combination of these mutations might permit efficient cleavage of sites that contain an A or C at the third position of the SaCas9 PAM. We therefore tested SaCas9 variants containing different combinations of these mutations using the human cell-based EGFP disruption assay with sgRNAs targeted to sites harboring each of the 4 bases at the third position of the PAM (i.e., on NNNRRT PAMs) (FIG. 21E, FIG. 32). We found that the variants with the triple mutant combinations E782K/N968K/R1015H and E782K/K929R/R1015H were highly active at sites with NNNRRT PAMs (FIG. 21E, FIG. 32), whereas the quadruple mutant variant containing all four mutations (E782K/K929R/N968K/R1015H) had generally lower activities on these sites (FIG. 32). We chose the E782K/N968K/R1015H (hereafter referred to as the KKH variant) for further characterization, and verified using our human cell-based EGFP disruption assay that all three substitutions comprising the KKH variant were required for activity (FIG. 21E).

Figure 21F:
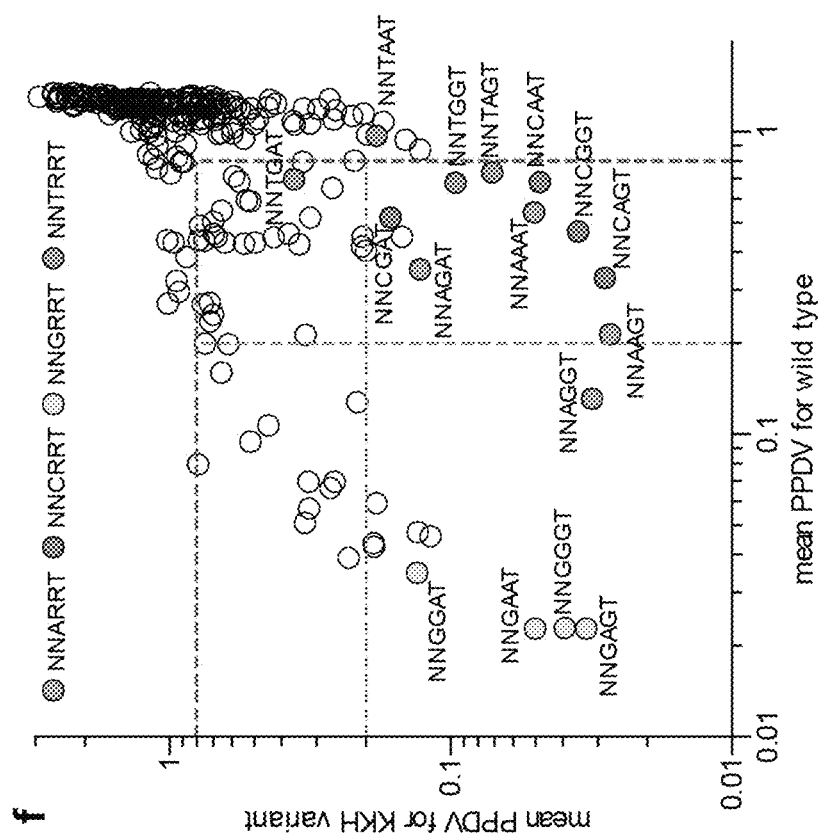
Figures 34D, 34E:
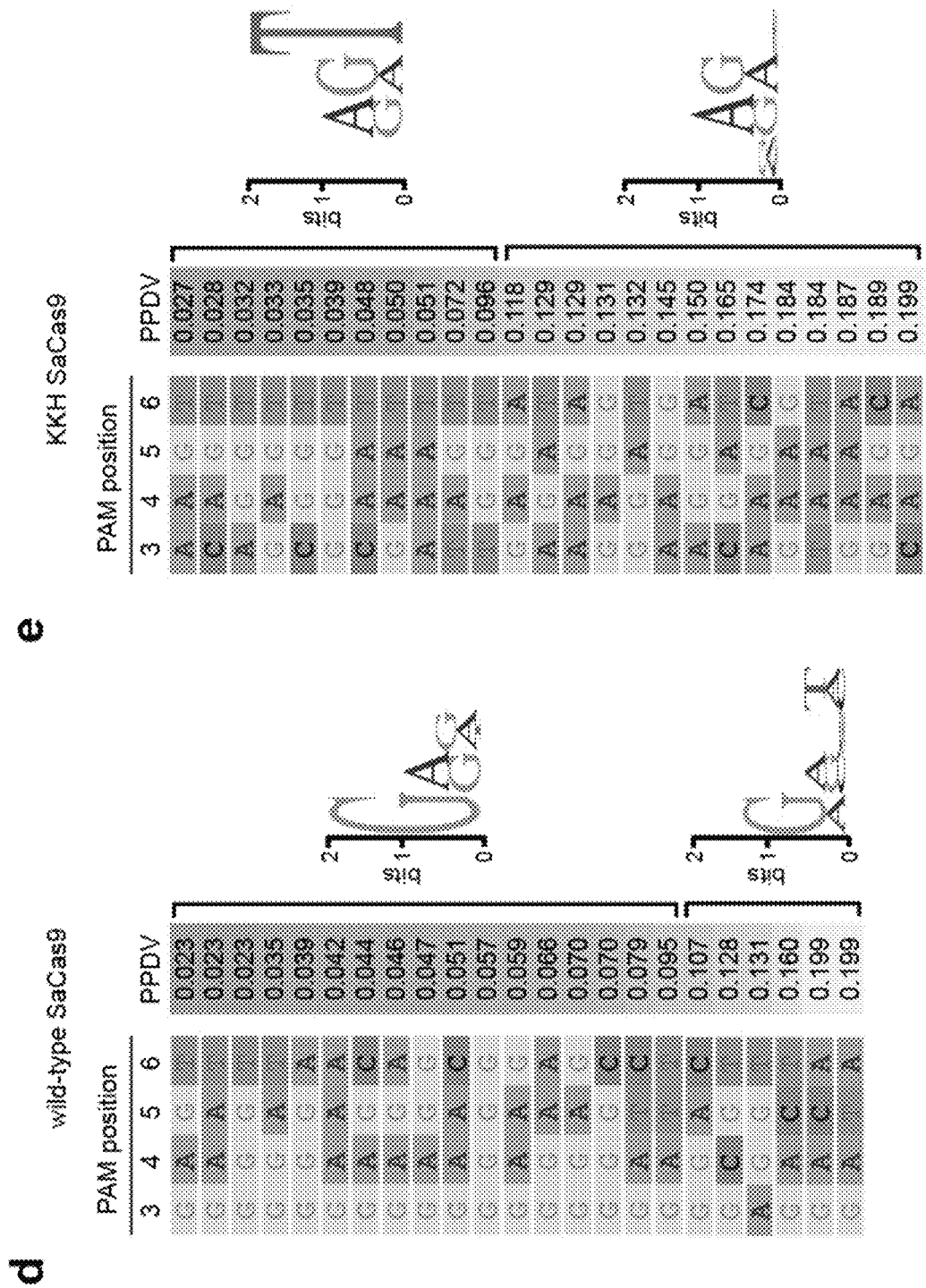

To more comprehensively define the PAM specificities of KKH and wild-type SaCas9, we used our previously described bacterial cell-based site-depletion assay (See Examples 1-2) (FIG. 33). This method yields Cas9 PAM specificity profiles by identifying the relative cleavage (and therefore depletion in bacterial cells) of DNA plasmids bearing randomized PAM sequences, quantified as a post-selection PAM depletion value (PPDV). We performed site-depletion experiments with both wild-type and KKH SaCas9 using libraries with two different spacer sequences each with 8 randomized bases in place of the PAM (FIG. 33). Control experiments using catalytically inactive SaCas9 showed little depletion of any PAM sequence (FIG. 34A), enabling us to establish a threshold for statistically significant depletion as a PPDV of 0.794 (FIG. 34B). Previous experiments have shown that PAMs with PPDVs of <0.2 in our bacterial site-depletion assay can be efficiently cleaved in our human cell-based EGFP disruption assay (See Examples 1-2). With wild-type SaCas9, the most depleted PAMs (based on mean PPDVs obtained from the two libraries) were, as expected, the four NNGRRT (SEQ ID NO:46) (PAMs (FIG. 21F and FIG. 34C). Interestingly, other PAMs with mean PPDVs <0.1 included those of the form NNGRRN (SEQ ID NO:49) (FIG. 34), suggesting that for some spacer sequences the last position of the PAM may not be fully specified as a T in our bacterial-based assay (although a previous report demonstrated by an in vitro PAM depletion assay, ChIP-seq, and targeting of endogenous human sites that a thymine at the sixth position of the PAM was highly preferred (Ran, F. A. et al. In vivo genome editing using *Staphylococcus aureus* Cas9. Nature 520, 186-191 (2015))). By contrast, with the KKH variant, PAMs with mean PPDVs of <0.2 included not only the NNGRRT (SEQ ID NO:46) PAMs but also all four NNARRT (SEQ ID NO:43), all four NNCRRT (SEQ ID NO:47), and three of the four NNTRRT (SEQ ID NO:48) PAMs (FIG. 21F, FIGS. 34C and 34E). These results suggested that KKH SaCas9 appears to have a broadened PAM targeting range relative to its wild-type counterpart.

To assess the robustness of the KKH SaCas9 variant in human cells, we tested its activity on 55 different endogenous gene target sites containing a variety of NNNRRT PAMs (FIG. 22A). The KKH variant showed efficient activity with a mean mutagenesis frequency of 24.7% across all sites, with 80% of sites (44 of 55 sites) showing greater than 5% disruption. Analysis of KKH SaCas9 activity across all 55 sites revealed ordered preferences for the $3^{rd}$ position of the PAM (NN[G>A=C>T]RRT; FIG. 22B) as well as the $4^{th}/5^{th}$ positions of the PAM (NNN[AG>GG>GA>AA]T; FIG. 22C). Consistent with this, we observed differences among the 16 possible combinations of the $3^{rd}/4^{th}/5^{th}$ positions of an NNNRRT PAM (FIG. 35A). KKH SaCas9 functioned efficiently on spacer lengths ranging from 21-23 nucleotides (FIG. 22D), spacer sequences with variable GC content (FIG. 35B), and PAMs with variable GC content (FIG. 35C). Sequence logos derived from sites cleaved with low, medium, and high efficiencies (0-10%, 10-30%, and >30% mean mutagenesis frequencies, respectively) revealed little sequence preference across the entire target site other than at the $4^{th}$ and $5^{th}$ positions of the NNNRRT PAM, and perhaps a slight preference for guanine at the $2^{nd}$ PAM position on sites cleaved with high efficiencies (FIG. 35D).

To demonstrate that the KKH variant enables modification of PAMs that cannot be targeted by wild-type SaCas9, we performed direct comparisons of these nucleases in human cells on sites bearing various NNNRRT PAMs. Assessment of 16 sites using our EGFP disruption assay and 16 endogenous human gene targets (FIGS. 22E and 22F, respectively) showed that KKH SaCas9 robustly modified target sites bearing NNNRRT PAMs whereas wild-type SaCas9 efficiently targeted only sites with NNGRRT (SEQ ID NO:46) PAMs. For all 24 sites with NNHRRT (SEQ ID NO:44) PAMs, the KKH variant induced substantially higher rates of mutagenesis than wild-type SaCas9; on the eight sites with NNGRRT (SEQ ID NO:46) PAMs, KKH SaCas9 induced comparable or slightly lower levels of mutagenesis compared with wild-type (FIGS. 22E and 22F). These results collectively demonstrate that the KKH variant can cleave sites with NNNRRT PAMs, thereby enabling targeting of sites with NNHRRT (SEQ ID NO:44) PAMs that currently cannot be efficiently altered by wild-type SaCas9 in human cells.

Figure 23A:
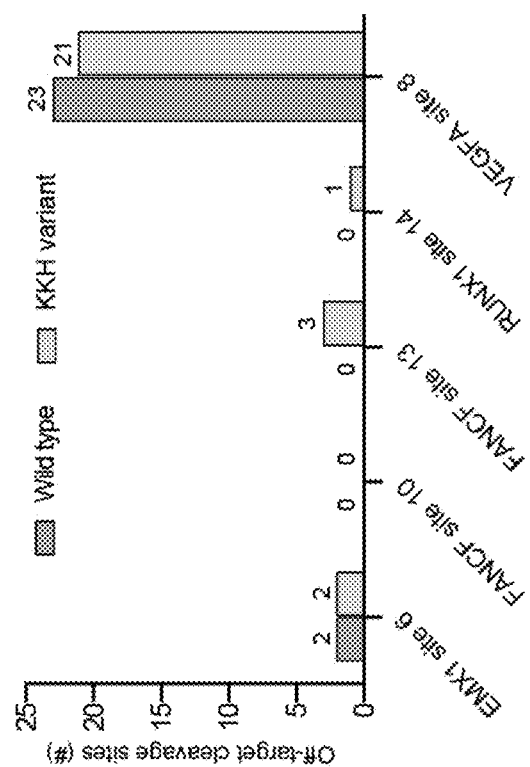
Figure 23B:
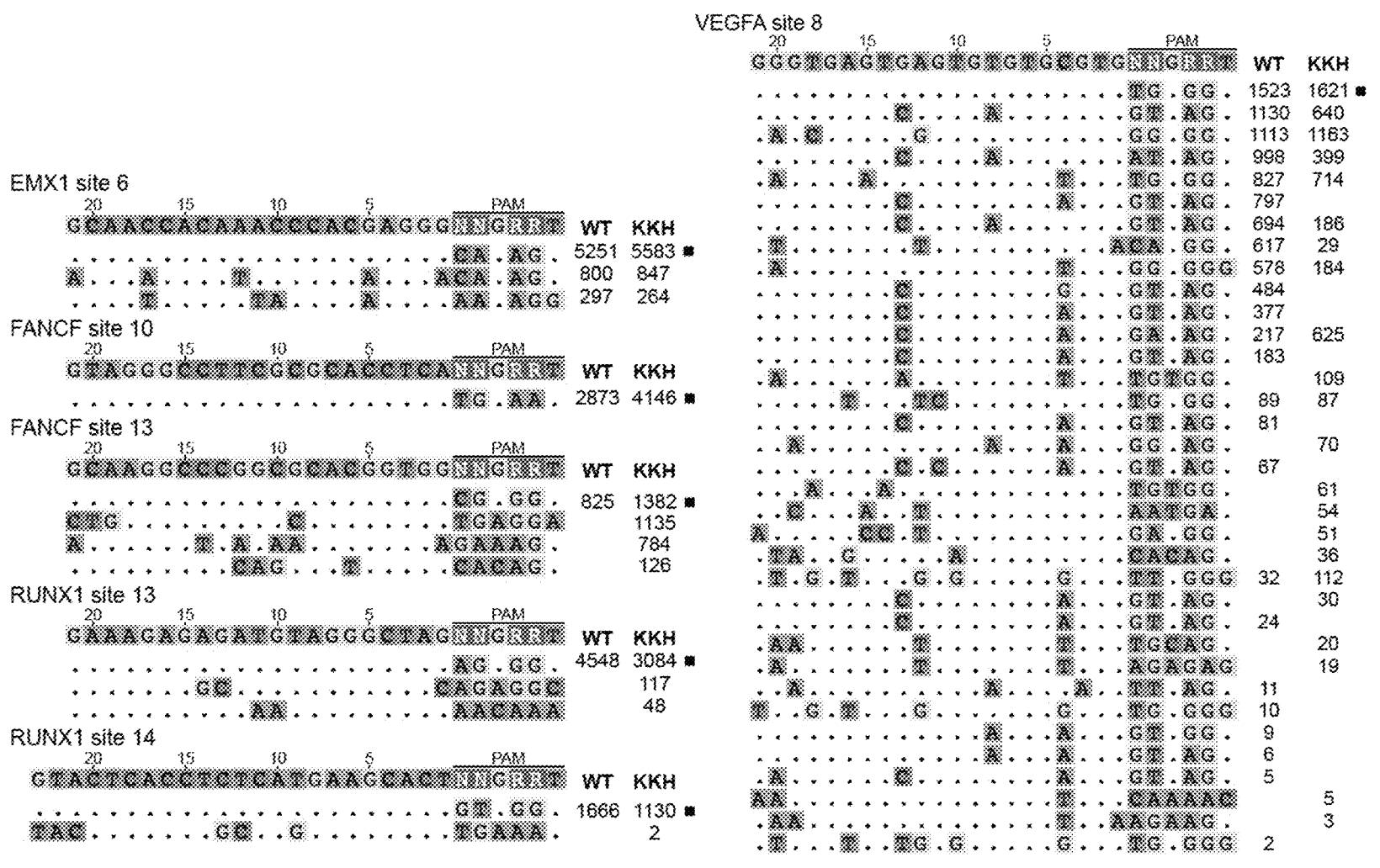

To assess the impact of the KKH mutations on the genome-wide specificity of SaCas9, we used the GUIDE-seq (Genome-wide Unbiased Identification of DSBs Enabled by sequencing) method (Tsai, S. Q. et al. GUIDE-seq enables genome-wide profiling of off-target cleavage by CRISPR-Cas nucleases. Nat Biotechnol 33, 187-197 (2015)) to directly compare the off-target profiles of wild-type and KKH SaCas9 with the same sgRNAs. When tested with sgRNAs targeted to six endogenous human gene sites containing NNGRRT (SEQ ID NO:46) PAMs, we observed that wild-type and KKH SaCas9 induced nearly identical GUIDE-seq tag integration rates and on-target cleavage frequencies for all six sites (FIGS. 36A and 36B, respectively). Furthermore, wild-type and KKH SaCas9 induce mutations at similar numbers of off-target sites with each of the six sgRNAs (FIGS. 23A and 23B). Off-target sites for the KKH variant generally adhered to the NNNRRT PAM motif, and off-target sites for wild-type SaCas9 adhered to an NNGRR|T>G| motif (FIG. 22B). With one of the sgRNAs, which induced the highest number of off-target sites among the six sgRNAs tested, we observed a similar number of off-target sites with wild-type and KKH SaCas9. However, the off-target sites were only partially overlapping between wild-type and KKH SaCas9, as might be expected given their different PAM specificities (FIGS. 23B and 23C). Although we would not advocate the use of the KKH variant for targeting sites with NNGRRT (SEQ ID NO:46) PAMs (because wild-type SaCas9 can show higher on-target activities than KKH for these sites), these results suggest that KKH SaCas9 only cleaves off-target sites with the expected PAMs and generally induces numbers of off-target sites comparable to those observed with wild-type SaCas9.

Figure 23D:
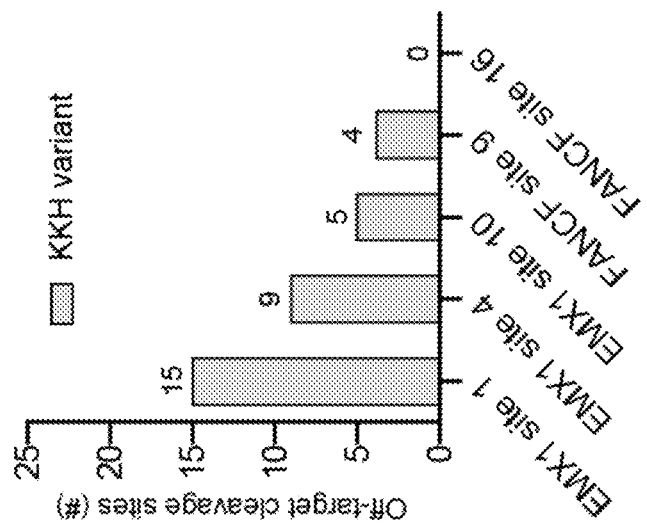
Figure 23C:
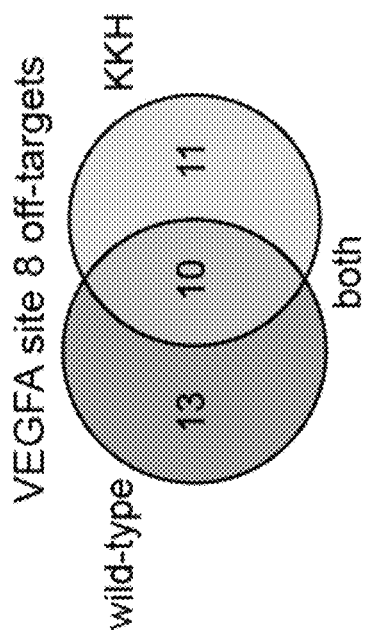
Figure 23E:
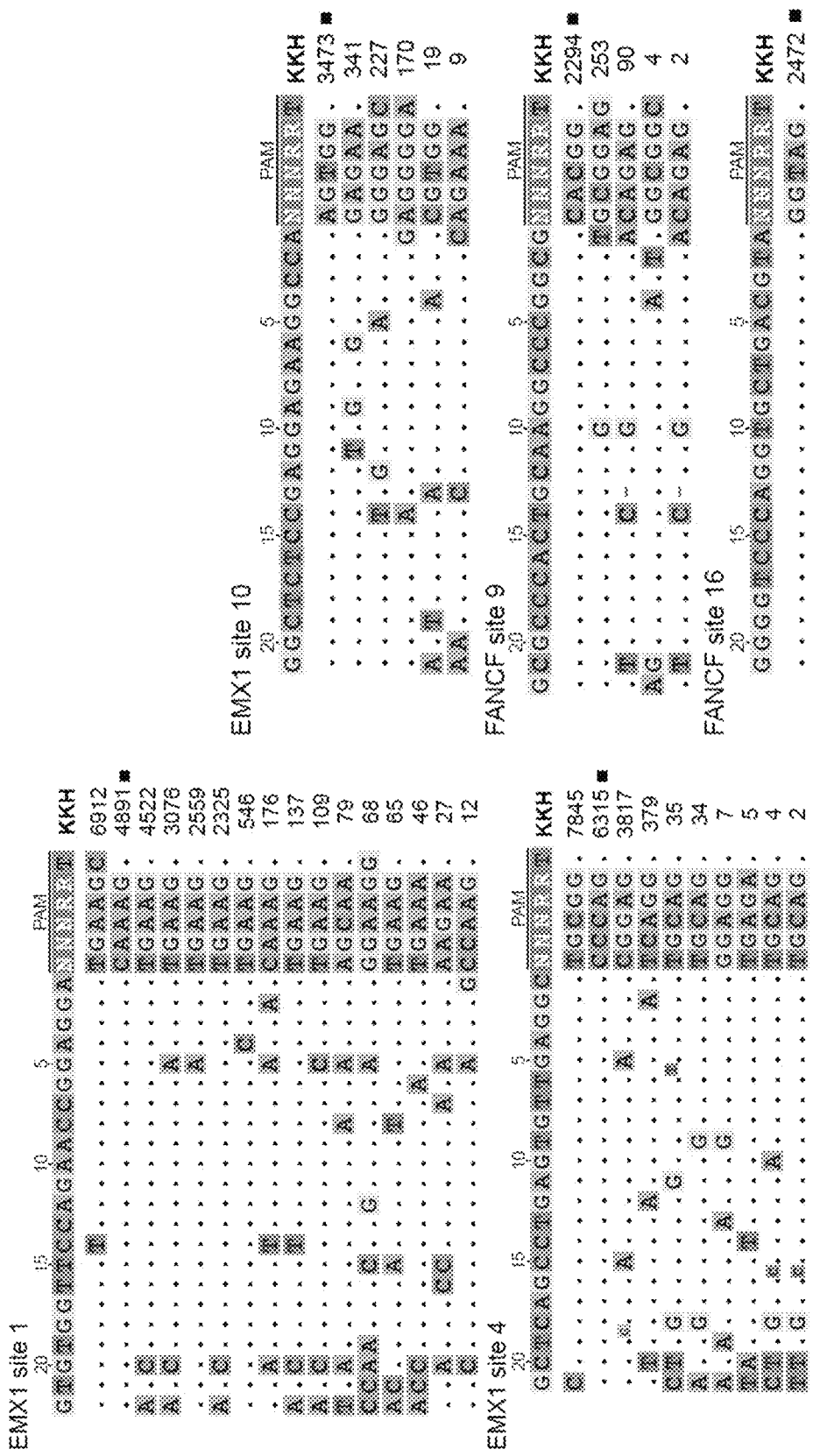

To further examine the genome-wide specificity of KKH SaCas9, we tested five additional sgRNAs targeted to sites containing NNHRRT (SEQ ID NO:44) PAMs (FIGS. 23D and 23E). Off-target sites detected by GUIDE-seq were generally low in number (comparable to the numbers observed with wild-type SpCas9 and SpCas9 variants in previously published experiments (See Examples 1-2 (Tsai, S. Q. et al. GUIDE-seq enables genome-wide profiling of off-target cleavage by CRISPR-Cas nucleases. Nat Biotechnol 33, 187-197 (2015)), displayed potential DNA- and RNA-bulged off-targets (Lin, Y. et al. CRISPR/Cas9 systems have off-target activity with insertions or deletions between target DNA and guide RNA sequences. Nucleic Acids Res 42, 7473-7485 (2014)), and contained expected PAM sequences. Taken together, our experiments demonstrate that the genome-wide specificities of wild-type and KKH SaCas9 are similar and generally show low numbers of off-target mutations in human cells as judged by GUIDE-seq.

Although wild-type SaCas9 remains the most optimal choice for targeting NNGRRT (SEQ ID NO:46) PAMs, the KKH SaCas9 variant we describe here can robustly target sites with NNARRT (SEQ ID NO:43) and NNCRRT (SEQ ID NO:47) PAMs and has a reasonable success rate for sites with NNTRRT (SEQ ID NO:48) PAMs. Thus, we conservatively estimate that the KKH variant increases the targeting range of SaCas9 by nearly two- to four-fold in random DNA sequence, thereby improving the prospects for more broadly utilizing SaCas9 in a variety of different applications that require highly precise targeting. Using GUIDE-seq, we demonstrated that KKH SaCas9 induces similar numbers of off-target mutations as wild-type SaCas9 when targeted to the same sites that contain NNGRRT (SEQ ID NO:46) PAMs. Also, KKH SaCas9 induces only a small number of off-target mutations when targeted to sites bearing NNHRRT (SEQ ID NO:44) PAMs. Although KKH SaCas9 recognizes a modified PAM sequence relative to wild-type SaCas9, our findings are not entirely surprising given that the total combined length of the protospacer and PAM is still long enough with the KKH variant (24 to 26 bps) to be reasonably orthogonal to the human genome. Furthermore, it is possible that modifying PAM recognition can improve specificity by altering the energetics of Cas9/sgRNA interaction with its target site (similar to the previously proposed mechanisms for improved specificities of truncated sgRNAs (Fu, Y., Sander, J. D., Reyon, D., Cascio, V. M. & Joung, J. K. Improving CRISPR-Cas nuclease specificity using truncated guide RNAs. Nat Biotechnol 32, 279-284 (2014)) or the D1135E SpCas9 mutant (See Examples 1-2)).

Example 4

Improving the Activity of the SpCas9-VQR Variant

Because the SpCas9-VQR variant has a preference for NGAN PAMs of: NGAG>NGAA=NGAT>NGAC, we sought to select for derivative variants that had improved activity against NGAH PAMs (where H=A, C, or T). Selections with the R1335Q library (with PI domain randomly mutagenized) against cells that contain target sites with either an NGAA, NGAT, or NGAC PAM enabled us to sequence additional clones that contained mutations that convey an altered PAM specificity. The sequences of these clones revealed additional mutations that might be important for altering PAM specificity towards NGAA, NGAT, or NGAC PAMs.

Based on the results of these selections, the VQR variant and 24 other derivative variants were tested against NGAG, NGAA, NGAT, and NGAC PAM sites in bacteria. A number of these derivative variants survived better than the VQR variant on NGAH PAM sites, most of which contained the G1218R mutation (Table 7 and FIG. 24).

TABLE 7

Table of variants and their corresponding amino acid changes.

| variant | | D1135 | G1218 | E1219 | R1335 | T1337 |
|---|---|---|---|---|---|---|
| A1 | VRQ | V | R | — | Q | — |
| A2 | NRQ | N | R | — | Q | — |
| A3 | YRQ | Y | R | — | Q | — |

TABLE 7-continued

Table of variants and their corresponding amino acid changes.

| variant | | D1135 | G1218 | E1219 | R1335 | T1337 |
|---|---|---|---|---|---|---|
| A4 | VRQL | V | R | — | Q | L |
| A5 | VRQM | V | R | — | Q | M |
| A6 | VRQR | V | R | — | Q | R |
| A7 | VRQE | V | R | — | Q | E |
| A8 | VRQQ | V | R | — | Q | Q |
| A9 | NRQL | N | R | — | Q | L |
| A10 | NRQM | N | R | — | Q | M |
| A11 | NRQR | N | R | — | Q | R |
| A12 | NRQE | N | R | — | Q | E |
| B1 | NRQQ | N | R | — | Q | Q |
| B2 | YRQL | Y | R | — | Q | L |
| B3 | YRQM | Y | R | — | Q | M |
| B4 | YRQR | Y | R | — | Q | R |
| B5 | YRQE | Y | R | — | Q | E |
| B6 | YRQQ | Y | R | — | Q | Q |
| B7 | VRVQE | V | R | V | Q | E |
| B8 | NRVQE | N | R | V | Q | E |
| B9 | YRVQE | Y | R | V | Q | E |
| B10 | VVQE | V | — | V | Q | E |
| B11 | NVQE | N | — | V | Q | E |
| B12 | YVQE | Y | — | V | Q | E |
| C1 | VQR | V | — | — | Q | R |

Given that the results from the bacterial screen demonstrated that some of these additional mutations improved activity against NGAH PAM sites, we tested some of the best candidates in human cells in the EGFP disruption assay. What we observed is that a number of these variants outperformed the VQR variant at targeting NGAH sites, including the VRQR, NRQR, and YRQR variants (Table 8 and FIG. 25). The main difference between these clones and the VQR variant is that they include a G1218R mutation.

TABLE 8

Table of SpCas9-VQR derivatives and their corresponding amino acid changes

| variant | D1135 | G1218 | R1335 | T1337 |
|---|---|---|---|---|
| VQR | V | — | Q | R |
| YRQ | Y | R | Q | — |
| VRQR | V | R | Q | R |
| VRQQ | V | R | Q | Q |
| NRQR | N | R | Q | R |
| NRQQ | N | R | Q | Q |
| YRQR | Y | R | Q | R |
| YRQQ | Y | R | Q | Q |

Because the VRQR variant appeared to be the most robust of those tested, we compared its activity to that of the VQR against 9 different endogenous sites in human cells (2 sites for each NGAA, NGAC, NGAT, and NGAG PAMs, and 1 site for an NGCG PAM). This data reveals that the VRQR variant outperforms the VQR variant at all sites tested in human cells (FIG. 26).

After demonstrating that VRQR variant has improved activity relative to the VQR variant, we sought to determine whether adding additional substitutions could further improve activity. Because we observed additional mutations in the selections that were in close proximity to the PAM interacting pocket of SpCas9, a subset of these mutations were added to the VQR and VRQR variants and screened in bacteria against sites containing NGAG, NGAA, NGAT, and NGAC PAMs (Table 9 and FIG. 27). A number of derivative variants appears to have higher activity against NGAT and NGAC PAM sites, so we proceeded to test these variants in human cells. We tested in the human cell EGFP disruption assay additional variants that contained added mutations to either the VQR or VRQR background. These experiments again revealed that the VRQR has more robust activity against NGAH PAMs than the VQR variant, and that additional mutations to the VRQR backbone are beneficial.

TABLE 9

Table of variants and their corresponding amino acid changes

| | variant | mutations |
|---|---|---|
| 1 | VQR + L1111H | L1111H/D1135V/R1335Q/T1337R |
| 2 | VRQR + L1111H | L1111H/D1135V/G1218R/R1335Q/T1337R |
| 3 | VQR + E1219K | D1135V/E1219K/R1335Q/T1337R |
| 4 | VQR + E1219V | D1135V/E1219V/R1335Q/T1337R |
| 5 | VQR + N1317K | D1135V/N1317K/R1335Q/T1337R |
| 6 | VRQR + N1317K | D1135V/G1218R/N1317K/R1335Q/T1337R |
| 7 | VQR + G1104K | G1104R/D1135V/R1335Q/T1337R |
| 8 | VRQR + G1104K | G1104R/D1135V/G1218R/R1335Q/T1337R |
| 9 | VQR + S1109T | S1109T/D1135V/R1335Q/T1337R |
| 10 | VRQR + S1109T | S1109T/D1135V/G1218R/R1335Q/T1337R |
| 11 | NQR + S1136N | D1135N/S1136N/R1335Q/T1337R |
| 12 | NRQR + S1136N | D1135N/S1136N/G1218R/R1335Q/T1337R |
| 13 | VQR | D1135V/R1335Q/T1337R |
| 14 | VRQR | D1135V/G1218R/R1335Q/T1337R |

Taken together, these results suggest that including additional mutations in the SpCas9-VQR variant can improve activity against sites that contain NGAN PAMs, specifically sites that contain NGAH PAMs.

REFERENCES

1. Sander, J. D. & Joung, J. K. CRISPR-Cas systems for editing, regulating and targeting genomes. Nat Biotechnol 32, 347-355 (2014).
2. Hsu, P. D., Lander, E. S. & Zhang, F. Development and applications of CRISPR-Cas9 for genome engineering. Cell 157, 1262-1278 (2014).

3. Doudna, J. A. & Charpentier, E. Genome editing. The new frontier of genome engineering with CRISPR-Cas9. Science 346, 1258096 (2014).
4. Barrangou, R. & May, A. P. Unraveling the potential of CRISPR-Cas9 for gene therapy. Expert Opin Biol Ther 15, 311-314 (2015).
5. Jinek, M. et al. A programmable dual-RNA-guided DNA endonuclease in adaptive bacterial immunity. Science 337, 816-821 (2012).
6. Sternberg, S. H., Redding, S., Jinek, M., Greene, E. C. & Doudna, J. A. DNA interrogation by the CRISPR RNA-guided endonuclease Cas9. Nature 507, 62-67 (2014).
7. Hsu, P. D. et al. DNA targeting specificity of RNA-guided Cas9 nucleases. Nat Biotechnol 31, 827-832 (2013).
8. Tsai, S. Q. et al. GUIDE-seq enables genome-wide profiling of off-target cleavage by CRISPR-Cas nucleases. Nat Biotechnol 33, 187-197 (2015).
9. Hou, Z. et al. Efficient genome engineering in human pluripotent stem cells using Cas9 from *Neisseria meningitidis*. Proc Natl Acad Sci USA (2013).
10. Fonfara, I. et al. Phylogeny of Cas9 determines functional exchangeability of dual-RNA and Cas9 among orthologous type II CRISPR-Cas systems. Nucleic Acids Res 42, 2577-2590 (2014).
11. Esvelt, K. M. et al. Orthogonal Cas9 proteins for RNA-guided gene regulation and editing. Nat Methods 10, 1116-1121 (2013).
12. Cong, L. et al. Multiplex genome engineering using CRISPR/Cas systems. Science 339, 819-823 (2013).
13. Horvath, P. et al. Diversity, activity, and evolution of CRISPR loci in *Streptococcus thermophilus*. J Bacteriol 190, 1401-1412 (2008).
14. Anders, C., Niewoehner, O., Duerst, A. & Jinek, M. Structural basis of PAM-dependent target DNA recognition by the Cas9 endonuclease. Nature 513, 569-573 (2014).
15. Reyon, D. et al. FLASH assembly of TALENs for high-throughput genome editing. Nat Biotechnol 30, 460-465 (2012).
16. Fu, Y. et al. High-frequency off-target mutagenesis induced by CRISPR-Cas nucleases in human cells. Nat Biotechnol 31, 822-826 (2013).
17. Chen, Z. & Zhao, H. A highly sensitive selection method for directed evolution of homing endonucleases. Nucleic Acids Res 33, e154 (2005).
18. Doyon, J. B., Pattanayak, V., Meyer, C. B. & Liu, D. R. Directed evolution and substrate specificity profile of homing endonuclease I-SceI. J Am Chem Soc 128, 2477-2484 (2006).
19. Jiang, W., Bikard, D., Cox, D., Zhang, F. & Marraffini, L. A. RNA-guided editing of bacterial genomes using CRISPR-Cas systems. Nat Biotechnol 31, 233-239 (2013).
20. Mali, P. et al. RNA-guided human genome engineering via Cas9. Science 339, 823-826 (2013).
21. Hwang, W. Y. et al. Efficient genome editing in zebrafish using a CRISPR-Cas system. Nat Biotechnol 31, 227-229 (2013).
22. Chylinski, K., Le Rhun, A. & Charpentier, E. The tracrRNA and Cas9 families of type II CRISPR-Cas immunity systems. RNA Biol 10, 726-737 (2013).
23. Kleinstiver, B. P., Fernandes, A. D., Gloor, G. B. & Edgell, D. R. A unified genetic, computational and experimental framework identifies functionally relevant residues of the homing endonuclease I-BmoI. Nucleic Acids Res 38, 2411-2427 (2010).
24. Gagnon, J. A. et al. Efficient mutagenesis by Cas9 protein-mediated oligonucleotide insertion and large-scale assessment of single-guide RNAs. PLoS One 9, e98186 (2014).

OTHER EMBODIMENTS

It is to be understood that while the invention has been described in conjunction with the detailed description thereof, the foregoing description is intended to illustrate and not limit the scope of the invention, which is defined by the scope of the appended claims. Other aspects, advantages, and modifications are within the scope of the following claims.

SEQUENCE LISTING (1021 sequences)

SEQ ID NO: 1 - protein, 1368 aa, Streptococcus pyogenes [sequence omitted]

SEQ ID NO: 2 - protein, 1053 aa, Staphylococcus aureus
MKRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEENSKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKHPQIIKKG

SEQ ID NO: 3 - DNA, 6 bp, Artificial Sequence
  Description of Artificial Sequence: Synthetic oligonucleotide
  modified_base (1)..(2): a, c, t, g, unknown or other
nnagaa

SEQ ID NO: 4 - DNA, 6 bp, Artificial Sequence
  Description of Artificial Sequence: Synthetic oligonucleotide
  modified_base (1)..(2): a, c, t, g, unknown or other
nngggt

SEQ ID NO: 5 - DNA, 6 bp, Artificial Sequence
  Description of Artificial Sequence: Synthetic oligonucleotide
  modified_base (1)..(2): a, c, t, g, unknown or other
nngagt

SEQ ID NO: 6 - DNA, 6 bp, Artificial Sequence
  Description of Artificial Sequence: Synthetic oligonucleotide
  modified_base (1)..(2): a, c, t, g, unknown or other
nngaat

SEQ ID NO: 7 - DNA, 4572 bp, Artificial Sequence
  Description of Artificial Sequence: Synthetic polynucleotide
taatacgactcactataggggaattgtgagcggataacaattcccctgtagaaataattttgtttaactttaataaggagatataccatggataaaaagtattctattggtttagacatcggcactaattccgttggatgggctgtcataaccgatgaatacaaagtaccttcaaagaaatttaaggtgttggggaacacagaccgtcattcgattaaaaagaatcttatcggtgccctcctattcgatagtggcgaaacggcagaggcgactcgcctgaaacgaaccgctcggagaaggtatacacgtcgcaagaaccgaatatgttacttacaagaaatttttagcaatgagatggccaaagttgacgattctttctttcaccgtttggaagagtccttccttgtcgaagaggacaagaaacatgaacggcaccccatctttggaaacatagtagatgaggtggcatatcatgaaaagtacccaacgatttatcacctcagaaaaaagctagttgactcaactgataaagcggacctgaggttaatctacttggctcttgcccatatgataaagttccgtgggcactttctcattgagggtgatctaaatccggacaactcggatgtcgacaaactgttcatccagttagtacaaacctataatcagttgtttgaagagaaccctataaatgcaagtggcgtggatgcgaaggctattcttagcgcccgcctctctaaatcccgacggctagaaaacctgatcgcacaattacccggagagaagaaaaatgggttgttcggtaaccttatagcgctctcactaggcctgacaccaaattttaagtcgaacttcgacttagctgaagatgccaaattgcagcttagtaaggacacgtacgatgacgatctcgacaatctactggcacaaattggagatcagtatgcggacttatttttggctgccaaaaaccttagcgatgcaatcctcctatctgacatactgagagttaatactgagattaccaaggcgccgttatccgcttcaatgatcaaaaggtacgatgaacatcaccaagacttgacacttctcaaggccctagtccgtcagcaactgcctgagaaatataaggaaatattctttgatcagtcgaaaaacgggtacgcaggttatattgacggcggagcgagtcaagaggaattctacaagtttatcaaacccatattagagaagatggatgggacggaagagttgcttgtaaaactcaatcgcgaagatctactgcgaaagcagcggactttcgacaacggtagcattccacatcaaatccacttaggcgaattgcatgctatacttagaaggcaggaggatttttatccgttcctcaaagacaatcgtgaaaagattgagaaaatcctaacctttcgcataccttactatgtgggacccctggcccgagggaactctcggttcgcatggatgacaagaaagtccgaagaaacgattactccctggaattttgaggaagttgtcgataaaggtgcgtcagctcaatcgttcatcgagaggatgaccaactttgacaagaatttaccgaacgaaaaagtattgcctaagcacagtttactttacgagtatttcacagtgtacaatgaactcacgaaagttaagtatgtcactgagggcatgcgtaaacccgcctttctaagcggagaacagaagaaagcaatagtagatctgttattcaagaccaaccgcaaagtgacagttaagcaattgaaagaggactactttaagaaaattgaatgcttcgattctgtcgagatctccggggtagaagatcgatttaatgcgtcacttggtacgtatcatgacctcctaaagataattaaagataaggacttcctggataacgaagagaatgaagatatcttagaagatatagtgttgactcttaccctctttgaagatcgggaaatgattgaggaaagactaaaaacatacgctcacctgttcgacgataaggttatgaaacagttaaagaggcgtcgctatacgggctggggacgattgtcgcggaaacttatcaacgggataagagacaagcaaagtggtaaaactattctcgattttctaaagagcgacggcttcgccaataggaactttatgcagctgatccatgatgactctttaaccttcaaagaggatatacaaaaggcacaggtttccggacaaggggactcattgcacgaacatattgcgaatcttgctggttcgccagccatcaaaaagggcatactccagacagtcaaagtagtggatgagctagttaaggtcatgggacgtcacaaaccggaaaacattgtaatcgagatggcacgcgaaaatcaaacgactcagaaggggcaaaaaaacagtcgagagcggatgaagagaatagaagagggtattaaagaactgggcagccagatcttaaaggagcatcctgtggaaaatacccaattgcagaacgagaaactttacctctattacctacaaaatggaagggacatgtatgttgatcaggaactggacataaaccgtttatctgattacgacgtcgatcacattgtaccccaatcctttttgaaggacgattcaatcgacaataaagtgcttacacgctcggataagaaccgagggaaaagtgacaatgttccaagcgaggaagtcgtaaagaaaatgaagaactattggcggcagctcctaaatgcgaaactgataacgcaaagaaagttcgataacttaactaaagctgagaggggtggcttgtctgaacttgacaaggccggatttattaaacgtcagctcgtggaaacccgccaaatcacaaagcatgttgcacagatactagattcccgaatgaatacgaaatacgacgagaacgataagctgattcgggaagtcaaagtaatcactttaaagtcaaaattggtgtcggacttcagaaaggattttcaattctataaagttagggagataaataactaccaccatgcgcacgacgcttatcttaatgccgtcgtagggaccgcactcattaagaaatacccgaagctagaaagtgagtttgtgtatggtgattacaaagtttatgacgtccgtaagatgatcgcgaaaagcgaacaggagataggcaaggctacagccaaatacttcttttattctaacattatgaatttctttaagacggaaatcactctggcaaacggagagatacgcaaacgacctttaattgaaaccaatggggagacaggtgaaatcgtatgggataagggccgggacttcgcgacggtgagaaaagttttgtccatgccccaagtcaacatagtaaagaaaactgaggtgcagaccggagggttttcaaaggaatcgattcttccaaaaaggaatagtgataagctcatcgctcgtaaaaaggactgggacccgaaaaagtacggtggcttcgatagccctacagttgcctattctgtcctagtagtggcaaaagttgagaagggaaaatccaagaaactgaagtcagtcaaagaattattggggataacgattatggagcgctcgtcttttgaaaagaaccccatcgacttccttgaggcgaaaggttacaaggaagtaaaaaaggatctcataattaaactaccaaagtatagtctgtttgagttagaaaatggccgaaaacggatgttggctagcgccggagagcttcaaaaggggaacgaactcgcactaccgtctaaatacgtgaatttcctgtatttagcgtcccattacgagaagttgaaaggttcacctgaagataacgaacagaagcaactttttgttgagcagcacaaacattatctcgacgaaatcatagagcaaatttcggaattcagtaagagagtcatcctagctgatgccaatctggacaaagtattaagcgcatacaacaagcacagggataaacccatacgtgagcaggcggaaaatattatccatttgtttactcttaccaacctcggcgctccagccgcattcaagtattttgacacaacgatagatcgcaaacgatacacttctaccaaggaggtgctagacgcgacactgattcaccaatccatcacgggattatatgaaactcggatagatttgtcacagcttgggggtgacggatcccccaagaagaagaggaaagtctcgagcgactacaaagaccatgacggtgattataaagatcatgacatcgattacaaggatgacgatgacaagtgaagcggccgcataatgcttaagtcgaacagaaagtaatcgtattgtacacggccgcataatcgaaattaatacgactcactatagggagacccatgccatagcgttgttcggaacagattcaccaacacctagtggtctccgttttagagctagaaatagcaagttaaaataaggctagtccgttatcaacttgaaaaagtggcaccgagtcggtgctccgctgagcaataactagcataaccccttggggcctctaaacgggtcttgaggggttttttg

SEQ ID NO: 8 - DNA, 4572 bp, Artificial Sequence
  Description of Artificial Sequence: Synthetic polynucleotide
taatacgactcactataggggaattgtgagcggataacaattcccctgtagaaataattttgtttaactttaataaggagatataccatggataaaaagtattctattggtttagccatcggcactaattccgttggatgggctgtcataaccgatgaatacaaagtaccttcaaagaaatttaaggtgttggggaacacagaccgtcattcgattaaaaagaatcttatcggtgccctcctattcgatagtggcgaaacggcagaggcgactcgcctgaaacgaaccgctcggagaaggtatacacgtcgcaagaaccgaatatgttacttacaagaaatttttagcaatgagatggccaaagttgacgattctttctttcaccgtttggaagagtccttccttgtcgaagaggacaagaaacatgaacggcaccccatctttggaaacatagtagatgaggtggcatatcatgaaaagtacccaacgatttatcacctcagaaaaaagctagttgactcaactgataaagcggacctgaggttaatctacttggctcttgcccatatgataaagttccgtgggcactttctcattgagggtgatctaaatccggacaactcggatgtcgacaaactgttcatccagttagtacaaacctataatcagttgtttgaagagaaccctataaatgcaagtggcgtggatgcgaaggctattcttagcgcccgcctctctaaatcccgacggctagaaaacctgatcgcacaattacccggagagaagaaaaatgggttgttcggtaaccttatagcgctctcactaggcctgacaccaaattttaagtcgaacttcgacttagctgaagatgccaaattgcagcttagtaaggacacgtacgatgacgatctcgacaatctactggcacaaattggagatcagtatgcggacttatttttggctgccaaaaaccttagcgatgcaatcctcctatctgacatactgagagttaatactgagattaccaaggcgccgttatccgcttcaatgatcaaaaggtacgatgaacatcaccaagacttgacacttctcaaggccctagtccgtcagcaactgcctgagaaatataaggaaatattctttgatcagtcgaaaaacgggtacgcaggttatattgacggcggagcgagtcaagaggaattctacaagtttatcaaacccatattagagaagatggatgggacggaagagttgcttgtaaaactcaatcgcgaagatctactgcgaaagcagcggactttcgacaacggtagcattccacatcaaatccacttaggcgaattgcatgctatacttagaaggcaggaggatttttatccgttcctcaaagacaatcgtgaaaagattgagaaaatcctaacctttcgcataccttactatgtgggacccctggcccgagggaactctcggttcgcatggatgacaagaaagtccgaagaaacgattactccctggaattttgaggaagttgtcgataaaggtgcgtcagctcaatcgttcatcgagaggatgaccaactttgacaagaatttaccgaacgaaaaagtattgcctaagcacagtttactttacgagtatttcacagtgtacaatgaactcacgaaagttaagtatgtcactgagggcatgcgtaaacccgcctttctaagcggagaacagaagaaagcaatagtagatctgttattcaagaccaaccgcaaagtgacagttaagcaattgaaagaggactactttaagaaaattgaatgcttcgattctgtcgagatctccggggtagaagatcgatttaatgcgtcacttggtacgtatcatgacctcctaaagataattaaagataaggacttcctggataacgaagagaatgaagatatcttagaagatatagtgttgactcttaccctctttgaagatcgggaaatgattgaggaaagactaaaaacatacgctcacctgttcgacgataaggttatgaaacagttaaagaggcgtcgctatacgggctggggacgattgtcgcggaaacttatcaacgggataagagacaagcaaagtggtaaaactattctcgattttctaaagagcgacggcttcgccaataggaactttatgcagctgatccatgatgactctttaaccttcaaagaggatatacaaaaggcacaggtttccggacaaggggactcattgcacgaacatattgcgaatcttgctggttcgccagccatcaaaaagggcatactccagacagtcaaagtagtggatgagctagttaaggtcatgggacgtcacaaaccggaaaacattgtaatcgagatggcacgcgaaaatcaaacgactcagaaggggcaaaaaaacagtcgagagcggatgaagagaatagaagagggtattaaagaactgggcagccagatcttaaaggagcatcctgtggaaaatacccaattgcagaacgagaaactttacctctattacctacaaaatggaagggacatgtatgttgatcaggaactggacataaaccgtttatctgattacgacgtcgatgccattgtaccccaatcctttttgaaggacgattcaatcgacaataaagtgcttacacgctcggataagaaccgagggaaaagtgacaatgttccaagcgaggaagtcgtaaagaaaatgaagaactattggcggcagctcctaaatgcgaaactgataacgcaaagaaagttcgataacttaactaaagctgagaggggtggcttgtctgaacttgacaaggccggatttattaaacgtcagctcgtggaaacccgccaaatcacaaagcatgttgcacagatactagattcccgaatgaatacgaaatacgacgagaacgataagctgattcgggaagtcaaagtaatcactttaaagtcaaaattggtgtcggacttcagaaaggattttcaattctataaagttagggagataaataactaccaccatgcgcacgacgcttatcttaatgccgtcgtagggaccgcactcattaagaaatacccgaagctagaaagtgagtttgtgtatggtgattacaaagtttatgacgtccgtaagatgatcgcgaaaagcgaacaggagataggcaaggctacagccaaatacttcttttattctaacattatgaatttctttaagacggaaatcactctggcaaacggagagatacgcaaacgacctttaattgaaaccaatggggagacaggtgaaatcgtatgggataagggccgggacttcgcgacggtgagaaaagttttgtccatgccccaagtcaacatagtaaagaaaactgaggtgcagaccggagggttttcaaaggaatcgattcttccaaaaaggaatagtgataagctcatcgctcgtaaaaaggactgggacccgaaaaagtacggtggcttcgatagccctacagttgcctattctgtcctagtagtggcaaaagttgagaagggaaaatccaagaaactgaagtcagtcaaagaattattggggataacgattatggagcgctcgtcttttgaaaagaaccccatcgacttccttgaggcgaaaggttacaaggaagtaaaaaaggatctcataattaaactaccaaagtatagtctgtttgagttagaaaatggccgaaaacggatgttggctagcgccggagagcttcaaaaggggaacgaactcgcactaccgtctaaatacgtgaatttcctgtatttagcgtcccattacgagaagttgaaaggttcacctgaagataacgaacagaagcaactttttgttgagcagcacaaacattatctcgacgaaatcatagagcaaatttcggaattcagtaagagagtcatcctagctgatgccaatctggacaaagtattaagcgcatacaacaagcacagggataaacccatacgtgagcaggcggaaaatattatccatttgtttactcttaccaacctcggcgctccagccgcattcaagtattttgacacaacgatagatcgcaaacgatacacttctaccaaggaggtgctagacgcgacactgattcaccaatccatcacgggattatatgaaactcggatagatttgtcacagcttgggggtgacggatcccccaagaagaagaggaaagtctcgagcgactacaaagaccatgacggtgattataaagatcatgacatcgattacaaggatgacgatgacaagtgaagcggccgcataatgcttaagtcgaacagaaagtaatcgtattgtacacggccgcataatcgaaattaatacgactcactatagggagacccatgccatagcgttgttcggaacagattcaccaacacctagtggtctccgttttagagctagaaatagcaagttaaaataaggctagtccgttatcaacttgaaaaagtggcaccgagtcggtgctccgctgagcaataactagcataaccccttggggcctctaaacgggtcttgaggggttttttg

SEQ ID NO: 9 - DNA, 3825 bp, Artificial Sequence
  Description of Artificial Sequence: Synthetic polynucleotide
taatacgactcactataggggaattgtgagcggataacaattcccctgtagaaataattttgtttaactttaataaggagatataccatgggcagcgacctggtgctgggcctggacatcggcatcggcagcgtgggcgtgggcatcctgaacaaggtgaccggcgagatcatccacaagaacagtcgcatcttccctgctgctcaggctgagaacaacctggtgcgccgcaccaaccgccagggtcgccggcttgctcgccgcaagaagcaccggcgcgtgcgcctgaaccgcctgttcgaggagagcggcctgatcaccgacttcaccaagatcagcatcaacctgaacccctaccagctgcgcgtgaagggcctgaccgacgagctgagcaacgaggagctgttcatcgccctgaagaacatggtgaagcaccgcggcatcagctacctggacgacgccagcgacgacggcaacagcagcgtgggcgactacgcccagatcgtgaaggagaacagcaagcagctggagaccaagacccccggccagatccagctggagcgctaccagacctacggccagctgcgcggcgacttcaccgtggagaaggacggcaagaagcaccgcctgatcaacgtgttccccaccagcgcctaccgcagcgaggccctgcgcatcctgcagacccagcaggagttcaacccccagatcaccgacgagttcatcaaccgctacctggagatcctgaccggcaagcgcaagtactaccacggccccggcaacgagaagagccgcaccgactacggccgctaccgcaccagcggcgagaccctggacaacatcttcggcatcctgatcggcaagtgcaccttctaccccgacgagttccgcgccgccaaggccagctacaccgcccaggagttcaatctgctgaacgacctgaacaacctgaccgtgcccaccgagaccaagaagctgagcaaggagcagaagaaccagatcatcaactacgtgaagaacgagaaggctatgggccccgccaagctgttcaagtacatcgccaagctgctgagctgcgacgtggccgacatcaagggctaccgcatcgacaagagcggcaaggccgagatccacaccttcgaggcctaccgcaagatgaagaccctggagaccctggacatcgagcagatggaccgagagaccctggacaagctggcctacgtgctgaccctgaacaccgagcgcgagggcatccaggaggccctggagcacgagttcgccgacggcagcttcagccagaaacaggtggacgagctggtgcagttccgcaaggccaacagcagcatcttcggcaagggctggcacaacttcagcgtgaagctgatgatggagctgatccccgagctgtacgagaccagcgaggagcagatgaccatcctgacccgcctgggcaagcagaagaccaccagcagcagcaacaagaccaagtacatcgacgagaagctgctgaccgaggagatctacaaccccgtggtggccaagagcgtgcgccaggccatcaagatcgtgaacgccgccatcaaggagtacggcgacttcgacaacatcgtgatcgagatggcccgcgagaccaacgaggacgacgagaagaaggccatccagaagatccagaaggccaacaaggacgagaaggacgccgccatgctgaaggccgccaaccagtacaacggcaaggccgagctgccccacagcgtgttccacggccacaagcagctggccaccaagatccgcctgtggcaccagcagggcgagcgctgcctgtacaccggcaagaccatcagcatccacgacctgatcaacaacagcaaccagttcgaggtggaccacatcctgcccctgagcatcaccttcgacgacagcctggccaacaaggtgctggtgtacgccaccgccaaccaggagaagggccagcgcaccccctaccaggccctggacagcatggacgacgcctggagcttccgcgagctgaaggccttcgtgcgcgagagcaagaccctgagcaacaagaagaaggagtatctgctgaccgaggaggacatcagcaagttcgacgtgcgcaagaagttcatcgagcgcaacctggtggacacccgctacgccagccgcgtggtgctgaacgccctgcaggagcacttccgcgcccacaagatcgacaccaaggtgagcgtggtgcgcggccagttcaccagccagctgcgccgccactggggcatcgagaagacccgcgacacctaccaccaccacgccgtggacgccctgatcattgcggcttctagccagctgaacctgtggaagaagcagaagaacaccctggtgagctacagcgaggaccagctgctggacatcgagaccggcgagctgatcagcgacgacgagtacaaggagagcgtgttcaaggccccctaccagcacttcgtggacaccctgaagagcaaggagttcgaggacagcatcctgttcagctaccaggtggacagcaagttcaaccgcaagatcagcgacgccaccatctacgccacccgccaggccaaggtgggcaaggacaaggccgacgagacctacgtgctgggcaagatcaaggacatctacacccaggacggctacgacgccttcatgaagatctacaagaaggacaagagcaagttcctgatgtaccgccacgacccccagaccttcgagaaggtgatcgagcccatcctggagaactaccccaacaagcagatcaacgataaaggcaaggaggtgccctgcaaccccttcctgaagtacaaggaggagcacggctacatccgcaagtacagcaagaagggcaacggccccgagatcaagagcctgaagtactacgacagcaagctgggcaaccacatcgacatcacccccaaggacagcaacaacaaggtggtgctgcagagcgtgagcccctggcgcgccgacgtgtacttcaacaagaccaccggcaagtacgagatcctggggctgaagtacgccgatctgcagtttgataaaggcacaggcacctacaagatcagccaggagaagtacaacgacatcaagaagaaggagggcgtggacagcgacagcgagttcaagttcaccctgtacaagaacgaccttctgctggtgaaggacaccgagaccaaggagcaacagctgttccgcttcctgagccgcaccatgcccaagcagaagcactacgtggagctgaagccctacgacaagcagaagttcgagggcggcgaggccctgatcaaggtgctgggcaacgtggccaacagcggccagtgcaagaagggcctgggcaagagcaacatcagcatctacaaggtgcgcaccgacgtgctgggcaaccagcacatcatcaagaacgagggcgacaagcccaagttggacttcagcagggctgaccccaagaagaagaggaaggtgtgagcggccgcataatgcttaagtcgaacagaaagtaatcgtattgtacacggccgcataatcgaaattaatacgactcactataggactgcaggtcatgccatagcgttgttcggaacagattcaccaacacctagtacctgcactcgtttttgtactctcaagatttaagtaactgtacaacgaaacttacacagttacttaaatcttgcagaagctacaaagataaggcttcatgccgaaatcaacaccctgtcattttatggcagggtgttttccgctgagcaataactagcataaccccttggggcctctaaacgggtcttgaggggttttttg

SEQ ID NO: 10 - DNA, 3674 bp, Artificial Sequence
  Description of Artificial Sequence: Synthetic polynucleotide
taatacgactcactataggggaattgtgagcggataacaattcccctgtagaaataattttgtttaactttaataaggagatataccatgggcaaacggaactacatcctggggcttgacattgggataaccagcgttggctacggaattattgattatgagacacgcgatgtgattgacgccggggttaggctgttcaaagaggccaacgttgaaaacaacgagggaagacggagtaagcgcggagcaagaagactcaagcgcagacggagacatcggattcagagggtgaaaaagctgctcttcgattacaatctcctgaccgatcatagtgagctgagcggaatcaacccctacgaggcgcgagtgaaagggctttcccagaagctgtccgaagaggagttctccgccgcgttgctgcacctggccaaacggaggggggttcacaatgtaaacgaagtggaggaggacacgggcaatgaacttagtacgaaagaacagatcagtaggaactctaaggctctcgaagagaaatacgtcgctgagttgcagcttgagagactgaaaaaagacggcgaagtacgcggatctattaataggttcaagacttcagattacgtaaaggaagccaagcagctcctgaaagtacagaaagcgtaccatcagctcgatcagagcttcatcgatacctacatagatttgctggagacacggaggacatactacgagggcccaggggaaggatctccttttgggtggaaggacatcaaggaatggtacgagatgcttatgggacattgtacatattttccggaggagctcaggagcgtcaagtacgcctacaatgccgacctgtacaatgccctcaatgacctcaataacctcgtgattaccagggacgagaacgagaagctggagtactatgaaaagttccagattatcgagaatgtgtttaagcagaagaagaagccgacacttaagcagattgcaaaggaaatcctcgtgaatgaggaagatatcaagggatacagagtgacaagtacaggcaagcccgagttcacaaatctgaaggtgtaccacgatattaaggacataaccgcacgaaaggagataatcgaaaacgctgagctcctcgatcagatcgcaaaaattcttaccatctaccagtctagtgaggacattcaggaggaactgactaatctgaacagtgagctcacccaagaggaaattgagcagatttcaaacctgaaaggctacaccgggacgcacaatctgagcctcaaagcaatcaacctcattctggatgaactttggcacacaaatgacaaccaaattgccatattcaaccgcctgaaactggtgccaaaaaaagtggatctgtcacagcaaaaggaaatccctacaaccttggttgacgattttattctgtcccccgttgtcaagcggagcttcatccagtcaatcaaggtgatcaatgccatcattaaaaaatacggattgccaaacgatataattatcgagcttgcacgagagaagaactcaaaggacgcccagaagatgattaacgaaatgcagaagcgcaaccgccagacaaacgaacgcatagaggaaattataagaacaaccggcaaagagaatgccaagtatctgatcgagaaaatcaagctgcacgacatgcaagaaggcaagtgcctgtactctctggaagctatcccactcgaagatctgctgaataatccattcaattacgaggtggaccacatcatccctagatccgtaagctttgacaattccttcaataacaaagttctggttaaacaggaggaaaattctaaaaaagggaaccggaccccgttccagtacctgagctccagtgacagcaagattagctacgagacttttaagaaacatattctgaatctggccaaaggcaaaggcaggatcagcaagaccaagaaggagtacctcctcgaagaacgcgacattaacagatttagtgtgcagaaagatttcatcaaccgaaaccttgtcgatactcggtacgccacgagaggcctgatgaatctcctcaggagctacttccgcgtcaataatctggacgttaaagtcaagagcataaatgggggattcaccagctttctgaggagaaagtggaagtttaagaaggaacgaaacaaaggatacaagcaccatgctgaggatgctttgatcatcgctaacgcggactttatctttaaggaatggaaaaagctggataaggcaaagaaagtgatggaaaaccagatgttcgaggagaagcaggcagagtcaatgcctgagatcgagacagagcaggaatacaaggaaattttcatcacccctcatcagattaaacacataaaggacttcaaagactataaatactctcatagggtggacaaaaaacccaatcgcgagctcattaatgacaccctgtactcaacacggaaggatgataaaggtaataccttgattgtgaataatcttaatggattgtatgacaaagataacgacaagctcaagaagctgatcaacaagtctccagagaagctccttatgtatcaccacgacccacagacttatcagaaattgaaactgatcatggagcaatacggggatgagaagaacccactctacaaatattatgaggaaacaggtaattacctgaccaagtactccaagaaggataacggaccagtgatcaaaaagataaagtactatggcaacaaacttaatgcgcatttggacataactgacgattaccccaattctcgaaacaaggttgtgaagctctccctgaagccttatagatttgacgtgtacctggataatggggtttataaattcgtcaccgtgaaaaatctggacgtgatcaaaaaggagaactattatgaagtaaactcaaagtgctatgaggaggcgaagaagctgaagaagatctccaatcaggccgagttcatcgcttccttctataataacgatctcatcaagatcaatggagagctttatcgcgtcattggtgtgaacaatgacttgctgaacaggatcgaagtcaatatgatagacattacctaccgggagtatctcgaaaacatgaatgataaacggccgcctcgcatcatcaagacaatcgcatctaaaactcagtcaataaaaaagtactctaccgatatcctggggaatctctatgaagtgaagtcaaagaagcacccacaaatcattaaaaaaggtggatcccccaagaagaagaggaaagtctcgagcgactacaaagaccatgacggtgattataaagatcatgacatcgattacaaggatgacgatgacaagtaaagcggccgcataatgcttaagtcgaacagaaagtaatcgtattgtacacggccgcataatcgaaattaatacgactcactatagggagacccatgccatagcgttgttcggaacagattcaccaacacctagtggtctccgttttagtactctgtaattttaggtatgaggtagacgaaaattgtacttatacctaaaattacagaatctactaaaacaaggcaaaatgccgtgtttatctcgtcaacttgttggcgagatccgctgagcaataactagcataaccccttggggcctctaaacgggtcttgaggggttttttg

SEQ ID NO: 11 - DNA, 4206 bp, Artificial Sequence
  Description of Artificial Sequence: Synthetic polynucleotide
atggataaaaagtattctattggtttagacatcggcactaattccgttggatgggctgtcataaccgatgaatacaaagtaccttcaaagaaatttaaggtgttggggaacacagaccgtcattcgattaaaaagaatcttatcggtgccctcctattcgatagtggcgaaacggcagaggcgactcgcctgaaacgaaccgctcggagaaggtatacacgtcgcaagaaccgaatatgttacttacaagaaatttttagcaatgagatggccaaagttgacgattctttctttcaccgtttggaagagtccttccttgtcgaagaggacaagaaacatgaacggcaccccatctttggaaacatagtagatgaggtggcatatcatgaaaagtacccaacgatttatcacctcagaaaaaagctagttgactcaactgataaagcggacctgaggttaatctacttggctcttgcccatatgataaagttccgtgggcactttctcattgagggtgatctaaatccggacaactcggatgtcgacaaactgttcatccagttagtacaaacctataatcagttgtttgaagagaaccctataaatgcaagtggcgtggatgcgaaggctattcttagcgcccgcctctctaaatcccgacggctagaaaacctgatcgcacaattacccggagagaagaaaaatgggttgttcggtaaccttatagcgctctcactaggcctgacaccaaattttaagtcgaacttcgacttagctgaagatgccaaattgcagcttagtaaggacacgtacgatgacgatctcgacaatctactggcacaaattggagatcagtatgcggacttatttttggctgccaaaaaccttagcgatgcaatcctcctatctgacatactgagagttaatactgagattaccaaggcgccgttatccgcttcaatgatcaaaaggtacgatgaacatcaccaagacttgacacttctcaaggccctagtccgtcagcaactgcctgagaaatataaggaaatattctttgatcagtcgaaaaacgggtacgcaggttatattgacggcggagcgagtcaagaggaattctacaagtttatcaaacccatattagagaagatggatgggacggaagagttgcttgtaaaactcaatcgcgaagatctactgcgaaagcagcggactttcgacaacggtagcattccacatcaaatccacttaggcgaattgcatgctatacttagaaggcaggaggatttttatccgttcctcaaagacaatcgtgaaaagattgagaaaatcctaacctttcgcataccttactatgtgggacccctggcccgagggaactctcggttcgcatggatgacaagaaagtccgaagaaacgattactccctggaattttgaggaagttgtcgataaaggtgcgtcagctcaatcgttcatcgagaggatgaccaactttgacaagaatttaccgaacgaaaaagtattgcctaagcacagtttactttacgagtatttcacagtgtacaatgaactcacgaaagttaagtatgtcactgagggcatgcgtaaacccgcctttctaagcggagaacagaagaaagcaatagtagatctgttattcaagaccaaccgcaaagtgacagttaagcaattgaaagaggactactttaagaaaattgaatgcttcgattctgtcgagatctccggggtagaagatcgatttaatgcgtcacttggtacgtatcatgacctcctaaagataattaaagataaggacttcctggataacgaagagaatgaagatatcttagaagatatagtgttgactcttaccctctttgaagatcgggaaatgattgaggaaagactaaaaacatacgctcacctgttcgacgataaggttatgaaacagttaaagaggcgtcgctatacgggctggggacgattgtcgcggaaacttatcaacgggataagagacaagcaaagtggtaaaactattctcgattttctaaagagcgacggcttcgccaataggaactttatgcagctgatccatgatgactctttaaccttcaaagaggatatacaaaaggcacaggtttccggacaaggggactcattgcacgaacatattgcgaatcttgctggttcgccagccatcaaaaagggcatactccagacagtcaaagtagtggatgagctagttaaggtcatgggacgtcacaaaccggaaaacattgtaatcgagatggcacgcgaaaatcaaacgactcagaaggggcaaaaaaacagtcgagagcggatgaagagaatagaagagggtattaaagaactgggcagccagatcttaaaggagcatcctgtggaaaatacccaattgcagaacgagaaactttacctctattacctacaaaatggaagggacatgtatgttgatcaggaactggacataaaccgtttatctgattacgacgtcgatcacattgtaccccaatcctttttgaaggacgattcaatcgacaataaagtgcttacacgctcggataagaaccgagggaaaagtgacaatgttccaagcgaggaagtcgtaaagaaaatgaagaactattggcggcagctcctaaatgcgaaactgataacgcaaagaaagttcgataacttaactaaagctgagaggggtggcttgtctgaacttgacaaggccggatttattaaacgtcagctcgtggaaacccgccaaatcacaaagcatgttgcacagatactagattcccgaatgaatacgaaatacgacgagaacgataagctgattcgggaagtcaaagtaatcactttaaagtcaaaattggtgtcggacttcagaaaggattttcaattctataaagttagggagataaataactaccaccatgcgcacgacgcttatcttaatgccgtcgtagggaccgcactcattaagaaatacccgaagctagaaagtgagtttgtgtatggtgattacaaagtttatgacgtccgtaagatgatcgcgaaaagcgaacaggagataggcaaggctacagccaaatacttcttttattctaacattatgaatttctttaagacggaaatcactctggcaaacggagagatacgcaaacgacctttaattgaaaccaatggggagacaggtgaaatcgtatgggataagggccgggacttcgcgacggtgagaaaagttttgtccatgccccaagtcaacatagtaaagaaaactgaggtgcagaccggagggttttcaaaggaatcgattcttccaaaaaggaatagtgataagctcatcgctcgtaaaaaggactgggacccgaaaaagtacggtggcttcgatagccctacagttgcctattctgtcctagtagtggcaaaagttgagaagggaaaatccaagaaactgaagtcagtcaaagaattattggggataacgattatggagcgctcgtcttttgaaaagaaccccatcgacttccttgaggcgaaaggttacaaggaagtaaaaaaggatctcataattaaactaccaaagtatagtctgtttgagttagaaaatggccgaaaacggatgttggctagcgccggagagcttcaaaaggggaacgaactcgcactaccgtctaaatacgtgaatttcctgtatttagcgtcccattacgagaagttgaaaggttcacctgaagataacgaacagaagcaactttttgttgagcagcacaaacattatctcgacgaaatcatagagcaaatttcggaattcagtaagagagtcatcctagctgatgccaatctggacaaagtattaagcgcatacaacaagcacagggataaacccatacgtgagcaggcggaaaatattatccatttgtttactcttaccaacctcggcgctccagccgcattcaagtattttgacacaacgatagatcgcaaacgatacacttctaccaaggaggtgctagacgcgacactgattcaccaatccatcacgggattatatgaaactcggatagatttgtcacagcttgggggtgacggatcccccaagaagaagaggaaagtctcgagcgactacaaagaccatgacggtgattataaagatcatgacatcgattacaaggatgacgatgacaagtga

SEQ ID NO: 12 - DNA, 4206 bp, Artificial Sequence
  Description of Artificial Sequence: Synthetic polynucleotide
atggataaaaagtattctattggtttagacatcggcactaattccgttggatgggctgtcataaccgatgaatacaaagtaccttcaaagaaatttaaggtgttggggaacacagaccgtcattcgattaaaaagaatcttatcggtgccctcctattcgatagtggcgaaacggcagaggcgactcgcctgaaacgaaccgctcggagaaggtatacacgtcgcaagaaccgaatatgttacttacaagaaatttttagcaatgagatggccaaagttgacgattctttctttcaccgtttggaagagtccttccttgtcgaagaggacaagaaacatgaacggcaccccatctttggaaacatagtagatgaggtggcatatcatgaaaagtacccaacgatttatcacctcagaaaaaagctagttgactcaactgataaagcggacctgaggttaatctacttggctcttgcccatatgataaagttccgtgggcactttctcattgagggtgatctaaatccggacaactcggatgtcgacaaactgttcatccagttagtacaaacctataatcagttgtttgaagagaaccctataaatgcaagtggcgtggatgcgaaggctattcttagcgcccgcctctctaaatcccgacggctagaaaacctgatcgcacaattacccggagagaagaaaaatgggttgttcggtaaccttatagcgctctcactaggcctgacaccaaattttaagtcgaacttcgacttagctgaagatgccaaattgcagcttagtaaggacacgtacgatgacgatctcgacaatctactggcacaaattggagatcagtatgcggacttatttttggctgccaaaaaccttagcgatgcaatcctcctatctgacatactgagagttaatactgagattaccaaggcgccgttatccgcttcaatgatcaaaaggtacgatgaacatcaccaagacttgacacttctcaaggccctagtccgtcagcaactgcctgagaaatataaggaaatattctttgatcagtcgaaaaacgggtacgcaggttatattgacggcggagcgagtcaagaggaattctacaagtttatcaaacccatattagagaagatggatgggacggaagagttgcttgtaaaactcaatcgcgaagatctactgcgaaagcagcggactttcgacaacggtagcattccacatcaaatccacttaggcgaattgcatgctatacttagaaggcaggaggatttttatccgttcctcaaagacaatcgtgaaaagattgagaaaatcctaacctttcgcataccttactatgtgggacccctggcccgagggaactctcggttcgcatggatgacaagaaagtccgaagaaacgattactccctggaattttgaggaagttgtcgataaaggtgcgtcagctcaatcgttcatcgagaggatgaccaactttgacaagaatttaccgaacgaaaaagtattgcctaagcacagtttactttacgagtatttcacagtgtacaatgaactcacgaaagttaagtatgtcactgagggcatgcgtaaacccgcctttctaagcggagaacagaagaaagcaatagtagatctgttattcaagaccaaccgcaaagtgacagttaagcaattgaaagaggactactttaagaaaattgaatgcttcgattctgtcgagatctccggggtagaagatcgatttaatgcgtcacttggtacgtatcatgacctcctaaagataattaaagataaggacttcctggataacgaagagaatgaagatatcttagaagatatagtgttgactcttaccctctttgaagatcgggaaatgattgaggaaagactaaaaacatacgctcacctgttcgacgataaggttatgaaacagttaaagaggcgtcgctatacgggctggggacgattgtcgcggaaacttatcaacgggataagagacaagcaaagtggtaaaactattctcgattttctaaagagcgacggcttcgccaataggaactttatgcagctgatccatgatgactctttaaccttcaaagaggatatacaaaaggcacaggtttccggacaaggggactcattgcacgaacatattgcgaatcttgctggttcgccagccatcaaaaagggcatactccagacagtcaaagtagtggatgagctagttaaggtcatgggacgtcacaaaccggaaaacattgtaatcgagatggcacgcgaaaatcaaacgactcagaaggggcaaaaaaacagtcgagagcggatgaagagaatagaagagggtattaaagaactgggcagccagatcttaaaggagcatcctgtggaaaatacccaattgcagaacgagaaactttacctctattacctacaaaatggaagggacatgtatgttgatcaggaactggacataaaccgtttatctgattacgacgtcgatcacattgtaccccaatcctttttgaaggacgattcaatcgacaataaagtgcttacacgctcggataagaaccgagggaaaagtgacaatgttccaagcgaggaagtcgtaaagaaaatgaagaactattggcggcagctcctaaatgcgaaactgataacgcaaagaaagttcgataacttaactaaagctgagaggggtggcttgtctgaacttgacaaggccggatttattaaacgtcagctcgtggaaacccgccaaatcacaaagcatgttgcacagatactagattcccgaatgaatacgaaatacgacgagaacgataagctgattcgggaagtcaaagtaatcactttaaagtcaaaattggtgtcggacttcagaaaggattttcaattctataaagttagggagataaataactaccaccatgcgcacgacgcttatcttaatgccgtcgtagggaccgcactcattaagaaatacccgaagctagaaagtgagtttgtgtatggtgattacaaagtttatgacgtccgtaagatgatcgcgaaaagcgaacaggagataggcaaggctacagccaaatacttcttttattctaacattatgaatttctttaagacggaaatcactctggcaaacggagagatacgcaaacgacctttaattgaaaccaatggggagacaggtgaaatcgtatgggataagggccgggacttcgcgacggtgagaaaagttttgtccatgccccaagtcaacatagtaaagaaaactgaggtgcagaccggagggttttcaaaggaatcgattcttccaaaaaggaatagtgataagctcatcgctcgtaaaaaggactgggacccgaaaaagtacggtggcttcgtgagccctacagttgcctattctgtcctagtagtggcaaaagttgagaagggaaaatccaagaaactgaagtcagtcaaagaattattggggataacgattatggagcgctcgtcttttgaaaagaaccccatcgacttccttgaggcgaaaggttacaaggaagtaaaaaaggatctcataattaaactaccaaagtatagtctgtttgagttagaaaatggccgaaaacggatgttggctagcgccggagagcttcaaaaggggaacgaactcgcactaccgtctaaatacgtgaatttcctgtatttagcgtcccattacgagaagttgaaaggttcacctgaagataacgaacagaagcaactttttgttgagcagcacaaacattatctcgacgaaatcatagagcaaatttcggaattcagtaagagagtcatcctagctgatgccaatctggacaaagtattaagcgcatacaacaagcacagggataaacccatacgtgagcaggcggaaaatattatccatttgtttactcttaccaacctcggcgctccagccgcattcaagtattttgacacaacgatagatcgcaaacagtacagatctaccaaggaggtgctagacgcgacactgattcaccaatccatcacgggattatatgaaactcggatagatttgtcacagcttgggggtgacggatcccccaagaagaagaggaaagtctcgagcgactacaaagaccatgacggtgattataaagatcatgacatcgattacaaggatgacgatgacaagtga

SEQ ID NO: 13 - DNA, 4206 bp, Artificial Sequence
  Description of Artificial Sequence: Synthetic polynucleotide
atggataaaaagtattctattggtttagacatcggcactaattccgttggatgggctgtcataaccgatgaatacaaagtaccttcaaagaaatttaaggtgttggggaacacagaccgtcattcgattaaaaagaatcttatcggtgccctcctattcgatagtggcgaaacggcagaggcgactcgcctgaaacgaaccgctcggagaaggtatacacgtcgcaagaaccgaatatgttacttacaagaaatttttagcaatgagatggccaaagttgacgattctttctttcaccgtttggaagagtccttccttgtcgaagaggacaagaaacatgaacggcaccccatctttggaaacatagtagatgaggtggcatatcatgaaaagtacccaacgatttatcacctcagaaaaaagctagttgactcaactgataaagcggacctgaggttaatctacttggctcttgcccatatgataaagttccgtgggcactttctcattgagggtgatctaaatccggacaactcggatgtcgacaaactgttcatccagttagtacaaacctataatcagttgtttgaagagaaccctataaatgcaagtggcgtggatgcgaaggctattcttagcgcccgcctctctaaatcccgacggctagaaaacctgatcgcacaattacccggagagaagaaaaatgggttgttcggtaaccttatagcgctctcactaggcctgacaccaaattttaagtcgaacttcgacttagctgaagatgccaaattgcagcttagtaaggacacgtacgatgacgatctcgacaatctactggcacaaattggagatcagtatgcggacttatttttggctgccaaaaaccttagcgatgcaatcctcctatctgacatactgagagttaatactgagattaccaaggcgccgttatccgcttcaatgatcaaaaggtacgatgaacatcaccaagacttgacacttctcaaggccctagtccgtcagcaactgcctgagaaatataaggaaatattctttgatcagtcgaaaaacgggtacgcaggttatattgacggcggagcgagtcaagaggaattctacaagtttatcaaacccatattagagaagatggatgggacggaagagttgcttgtaaaactcaatcgcgaagatctactgcgaaagcagcggactttcgacaacggtagcattccacatcaaatccacttaggcgaattgcatgctatacttagaaggcaggaggatttttatccgttcctcaaagacaatcgtgaaaagattgagaaaatcctaacctttcgcataccttactatgtgggacccctggcccgagggaactctcggttcgcatggatgacaagaaagtccgaagaaacgattactccctggaattttgaggaagttgtcgataaaggtgcgtcagctcaatcgttcatcgagaggatgaccaactttgacaagaatttaccgaacgaaaaagtattgcctaagcacagtttactttacgagtatttcacagtgtacaatgaactcacgaaagttaagtatgtcactgagggcatgcgtaaacccgcctttctaagcggagaacagaagaaagcaatagtagatctgttattcaagaccaaccgcaaagtgacagttaagcaattgaaagaggactactttaagaaaattgaatgcttcgattctgtcgagatctccggggtagaagatcgatttaatgcgtcacttggtacgtatcatgacctcctaaagataattaaagataaggacttcctggataacgaagagaatgaagatatcttagaagatatagtgttgactcttaccctctttgaagatcgggaaatgattgaggaaagactaaaaacatacgctcacctgttcgacgataaggttatgaaacagttaaagaggcgtcgctatacgggctggggacgattgtcgcggaaacttatcaacgggataagagacaagcaaagtggtaaaactattctcgattttctaaagagcgacggcttcgccaataggaactttatgcagctgatccatgatgactctttaaccttcaaagaggatatacaaaaggcacaggtttccggacaaggggactcattgcacgaacatattgcgaatcttgctggttcgccagccatcaaaaagggcatactccagacagtcaaagtagtggatgagctagttaaggtcatgggacgtcacaaaccggaaaacattgtaatcgagatggcacgcgaaaatcaaacgactcagaaggggcaaaaaaacagtcgagagcggatgaagagaatagaagagggtattaaagaactgggcagccagatcttaaaggagcatcctgtggaaaatacccaattgcagaacgagaaactttacctctattacctacaaaatggaagggacatgtatgttgatcaggaactggacataaaccgtttatctgattacgacgtcgatcacattgtaccccaatcctttttgaaggacgattcaatcgacaataaagtgcttacacgctcggataagaaccgagggaaaagtgacaatgttccaagcgaggaagtcgtaaagaaaatgaagaactattggcggcagctcctaaatgcgaaactgataacgcaaagaaagttcgataacttaactaaagctgagaggggtggcttgtctgaacttgacaaggccggatttattaaacgtcagctcgtggaaacccgccaaatcacaaagcatgttgcacagatactagattcccgaatgaatacgaaatacgacgagaacgataagctgattcgggaagtcaaagtaatcactttaaagtcaaaattggtgtcggacttcagaaaggattttcaattctataaagttagggagataaataactaccaccatgcgcacgacgcttatcttaatgccgtcgtagggaccgcactcattaagaaatacccgaagctagaaagtgagtttgtgtatggtgattacaaagtttatgacgtccgtaagatgatcgcgaaaagcgaacaggagataggcaaggctacagccaaatacttcttttattctaacattatgaatttctttaagacggaaatcactctggcaaacggagagatacgcaaacgacctttaattgaaaccaatggggagacaggtgaaatcgtatgggataagggccgggacttcgcgacggtgagaaaagttttgtccatgccccaagtcaacatagtaaagaaaactgaggtgcagaccggagggttttcaaaggaatcgattcttccaaaaaggaatagtgataagctcatcgctcgtaaaaaggactgggacccgaaaaagtacggtggcttcgagagccctacagttgcctattctgtcctagtagtggcaaaagttgagaagggaaaatccaagaaactgaagtcagtcaaagaattattggggataacgattatggagcgctcgtcttttgaaaagaaccccatcgacttccttgaggcgaaaggttacaaggaagtaaaaaaggatctcataattaaactaccaaagtatagtctgtttgagttagaaaatggccgaaaacggatgttggctagcgccggagagcttcaaaaggggaacgaactcgcactaccgtctaaatacgtgaatttcctgtatttagcgtcccattacgagaagttgaaaggttcacctgaagataacgaacagaagcaactttttgttgagcagcacaaacattatctcgacgaaatcatagagcaaatttcggaattcagtaagagagtcatcctagctgatgccaatctggacaaagtattaagcgcatacaacaagcacagggataaacccatacgtgagcaggcggaaaatattatccatttgtttactcttaccaacctcggcgctccagccgcattcaagtattttgacacaacgatagatcgcaaacagtacagatctaccaaggaggtgctagacgcgacactgattcaccaatccatcacgggattatatgaaactcggatagatttgtcacagcttgggggtgacggatcccccaagaagaagaggaaagtctcgagcgactacaaagaccatgacggtgattataaagatcatgacatcgattacaaggatgacgatgacaagtga

SEQ ID NO: 14 - DNA, 4206 bp, Artificial Sequence
  Description of Artificial Sequence: Synthetic polynucleotide
atggataaaaagtattctattggtttagacatcggcactaattccgttggatgggctgtcataaccgatgaatacaaagtaccttcaaagaaatttaaggtgttggggaacacagaccgtcattcgattaaaaagaatcttatcggtgccctcctattcgatagtggcgaaacggcagaggcgactcgcctgaaacgaaccgctcggagaaggtatacacgtcgcaagaaccgaatatgttacttacaagaaatttttagcaatgagatggccaaagttgacgattctttctttcaccgtttggaagagtccttccttgtcgaagaggacaagaaacatgaacggcaccccatctttggaaacatagtagatgaggtggcatatcatgaaaagtacccaacgatttatcacctcagaaaaaagctagttgactcaactgataaagcggacctgaggttaatctacttggctcttgcccatatgataaagttccgtgggcactttctcattgagggtgatctaaatccggacaactcggatgtcgacaaactgttcatccagttagtacaaacctataatcagttgtttgaagagaaccctataaatgcaagtggcgtggatgcgaaggctattcttagcgcccgcctctctaaatcccgacggctagaaaacctgatcgcacaattacccggagagaagaaaaatgggttgttcggtaaccttatagcgctctcactaggcctgacaccaaattttaagtcgaacttcgacttagctgaagatgccaaattgcagcttagtaaggacacgtacgatgacgatctcgacaatctactggcacaaattggagatcagtatgcggacttatttttggctgccaaaaaccttagcgatgcaatcctcctatctgacatactgagagttaatactgagattaccaaggcgccgttatccgcttcaatgatcaaaaggtacgatgaacatcaccaagacttgacacttctcaaggccctagtccgtcagcaactgcctgagaaatataaggaaatattctttgatcagtcgaaaaacgggtacgcaggttatattgacggcggagcgagtcaagaggaattctacaagtttatcaaacccatattagagaagatggatgggacggaagagttgcttgtaaaactcaatcgcgaagatctactgcgaaagcagcggactttcgacaacggtagcattccacatcaaatccacttaggcgaattgcatgctatacttagaaggcaggaggatttttatccgttcctcaaagacaatcgtgaaaagattgagaaaatcctaacctttcgcataccttactatgtgggacccctggcccgagggaactctcggttcgcatggatgacaagaaagtccgaagaaacgattactccctggaattttgaggaagttgtcgataaaggtgcgtcagctcaatcgttcatcgagaggatgaccaactttgacaagaatttaccgaacgaaaaagtattgcctaagcacagtttactttacgagtatttcacagtgtacaatgaactcacgaaagttaagtatgtcactgagggcatgcgtaaacccgcctttctaagcggagaacagaagaaagcaatagtagatctgttattcaagaccaaccgcaaagtgacagttaagcaattgaaagaggactactttaagaaaattgaatgcttcgattctgtcgagatctccggggtagaagatcgatttaatgcgtcacttggtacgtatcatgacctcctaaagataattaaagataaggacttcctggataacgaagagaatgaagatatcttagaagatatagtgttgactcttaccctctttgaagatcgggaaatgattgaggaaagactaaaaacatacgctcacctgttcgacgataaggttatgaaacagttaaagaggcgtcgctatacgggctggggacgattgtcgcggaaacttatcaacgggataagagacaagcaaagtggtaaaactattctcgattttctaaagagcgacggcttcgccaataggaactttatgcagctgatccatgatgactctttaaccttcaaagaggatatacaaaaggcacaggtttccggacaaggggactcattgcacgaacatattgcgaatcttgctggttcgccagccatcaaaaagggcatactccagacagtcaaagtagtggatgagctagttaaggtcatgggacgtcacaaaccggaaaacattgtaatcgagatggcacgcgaaaatcaaacgactcagaaggggcaaaaaaacagtcgagagcggatgaagagaatagaagagggtattaaagaactgggcagccagatcttaaaggagcatcctgtggaaaatacccaattgcagaacgagaaactttacctctattacctacaaaatggaagggacatgtatgttgatcaggaactggacataaaccgtttatctgattacgacgtcgatcacattgtaccccaatcctttttgaaggacgattcaatcgacaataaagtgcttacacgctcggataagaaccgagggaaaagtgacaatgttccaagcgaggaagtcgtaaagaaaatgaagaactattggcggcagctcctaaatgcgaaactgataacgcaaagaaagttcgataacttaactaaagctgagaggggtggcttgtctgaacttgacaaggccggatttattaaacgtcagctcgtggaaacccgccaaatcacaaagcatgttgcacagatactagattcccgaatgaatacgaaatacgacgagaacgataagctgattcgggaagtcaaagtaatcactttaaagtcaaaattggtgtcggacttcagaaaggattttcaattctataaagttagggagataaataactaccaccatgcgcacgacgcttatcttaatgccgtcgtagggaccgcactcattaagaaatacccgaagctagaaagtgagtttgtgtatggtgattacaaagtttatgacgtccgtaagatgatcgcgaaaagcgaacaggagataggcaaggctacagccaaatacttcttttattctaacattatgaatttctttaagacggaaatcactctggcaaacggagagatacgcaaacgacctttaattgaaaccaatggggagacaggtgaaatcgtatgggataagggccgggacttcgcgacggtgagaaaagttttgtccatgccccaagtcaacatagtaaagaaaactgaggtgcagaccggagggttttcaaaggaatcgattcttccaaaaaggaatagtgataagctcatcgctcgtaaaaaggactgggacccgaaaaagtacggtggcttcgtgagccctacagttgcctattctgtcctagtagtggcaaaagttgagaagggaaaatccaagaaactgaagtcagtcaaagaattattggggataacgattatggagcgctcgtcttttgaaaagaaccccatcgacttccttgaggcgaaaggttacaaggaagtaaaaaaggatctcataattaaactaccaaagtatagtctgtttgagttagaaaatggccgaaaacggatgttggctagcgccagagagcttcaaaaggggaacgaactcgcactaccgtctaaatacgtgaatttcctgtatttagcgtcccattacgagaagttgaaaggttcacctgaagataacgaacagaagcaactttttgttgagcagcacaaacattatctcgacgaaatcatagagcaaatttcggaattcagtaagagagtcatcctagctgatgccaatctggacaaagtattaagcgcatacaacaagcacagggataaacccatacgtgagcaggcggaaaatattatccatttgtttactcttaccaacctcggcgctccagccgcattcaagtattttgacacaacgatagatcgcaaagagtacagatctaccaaggaggtgctagacgcgacactgattcaccaatccatcacgggattatatgaaactcggatagatttgtcacagcttgggggtgacggatcccccaagaagaagaggaaagtctcgagcgactacaaagaccatgacggtgattataaagatcatgacatcgattacaaggatgacgatgacaagtga

SEQ ID NO: 15 - DNA, 4206 bp, Artificial Sequence [sequence omitted]

SEQ ID NO: 16 - DNA, 3402 bp, Artificial Sequence
  Description of Artificial Sequence: Synthetic polynucleotide
atgggcagcgacctggtgctgggcctggacatcggcatcggcagcgtgggcgtgggcatcctgaacaaggtgaccggcgagatcatccacaagaacagtcgcatcttccctgctgctcaggctgagaacaacctggtgcgccgcaccaaccgccagggtcgccggcttgctcgccgcaagaagcaccggcgcgtgcgcctgaaccgcctgttcgaggagagcggcctgatcaccgacttcaccaagatcagcatcaacctgaacccctaccagctgcgcgtgaagggcctgaccgacgagctgagcaacgaggagctgttcatcgccctgaagaacatggtgaagcaccgcggcatcagctacctggacgacgccagcgacgacggcaacagcagcgtgggcgactacgcccagatcgtgaaggagaacagcaagcagctggagaccaagacccccggccagatccagctggagcgctaccagacctacggccagctgcgcggcgacttcaccgtggagaaggacggcaagaagcaccgcctgatcaacgtgttccccaccagcgcctaccgcagcgaggccctgcgcatcctgcagacccagcaggagttcaacccccagatcaccgacgagttcatcaaccgctacctggagatcctgaccggcaagcgcaagtactaccacggccccggcaacgagaagagccgcaccgactacggccgctaccgcaccagcggcgagaccctggacaacatcttcggcatcctgatcggcaagtgcaccttctaccccgacgagttccgcgccgccaaggccagctacaccgcccaggagttcaatctgctgaacgacctgaacaacctgaccgtgcccaccgagaccaagaagctgagcaaggagcagaagaaccagatcatcaactacgtgaagaacgagaaggctatgggccccgccaagctgttcaagtacatcgccaagctgctgagctgcgacgtggccgacatcaagggctaccgcatcgacaagagcggcaaggccgagatccacaccttcgaggcctaccgcaagatgaagaccctggagaccctggacatcgagcagatggaccgagagaccctggacaagctggcctacgtgctgaccctgaacaccgagcgcgagggcatccaggaggccctggagcacgagttcgccgacggcagcttcagccagaaacaggtggacgagctggtgcagttccgcaaggccaacagcagcatcttcggcaagggctggcacaacttcagcgtgaagctgatgatggagctgatccccgagctgtacgagaccagcgaggagcagatgaccatcctgacccgcctgggcaagcagaagaccaccagcagcagcaacaagaccaagtacatcgacgagaagctgctgaccgaggagatctacaaccccgtggtggccaagagcgtgcgccaggccatcaagatcgtgaacgccgccatcaaggagtacggcgacttcgacaacatcgtgatcgagatggcccgcgagaccaacgaggacgacgagaagaaggccatccagaagatccagaaggccaacaaggacgagaaggacgccgccatgctgaaggccgccaaccagtacaacggcaaggccgagctgccccacagcgtgttccacggccacaagcagctggccaccaagatccgcctgtggcaccagcagggcgagcgctgcctgtacaccggcaagaccatcagcatccacgacctgatcaacaacagcaaccagttcgaggtggaccacatcctgcccctgagcatcaccttcgacgacagcctggccaacaaggtgctggtgtacgccaccgccaaccaggagaagggccagcgcaccccctaccaggccctggacagcatggacgacgcctggagcttccgcgagctgaaggccttcgtgcgcgagagcaagaccctgagcaacaagaagaaggagtatctgctgaccgaggaggacatcagcaagttcgacgtgcgcaagaagttcatcgagcgcaacctggtggacacccgctacgccagccgcgtggtgctgaacgccctgcaggagcacttccgcgcccacaagatcgacaccaaggtgagcgtggtgcgcggccagttcaccagccagctgcgccgccactggggcatcgagaagacccgcgacacctaccaccaccacgccgtggacgccctgatcattgcggcttctagccagctgaacctgtggaagaagcagaagaacaccctggtgagctacagcgaggaccagctgctggacatcgagaccggcgagctgatcagcgacgacgagtacaaggagagcgtgttcaaggccccctaccagcacttcgtggacaccctgaagagcaaggagttcgaggacagcatcctgttcagctaccaggtggacagcaagttcaaccgcaagatcagcgacgccaccatctacgccacccgccaggccaaggtgggcaaggacaaggccgacgagacctacgtgctgggcaagatcaaggacatctacacccaggacggctacgacgccttcatgaagatctacaagaaggacaagagcaagttcctgatgtaccgccacgacccccagaccttcgagaaggtgatcgagcccatcctggagaactaccccaacaagcagatcaacgataaaggcaaggaggtgccctgcaaccccttcctgaagtacaaggaggagcacggctacatccgcaagtacagcaagaagggcaacggccccgagatcaagagcctgaagtactacgacagcaagctgggcaaccacatcgacatcacccccaaggacagcaacaacaaggtggtgctgcagagcgtgagcccctggcgcgccgacgtgtacttcaacaagaccaccggcaagtacgagatcctggggctgaagtacgccgatctgcagtttgataaaggcacaggcacctacaagatcagccaggagaagtacaacgacatcaagaagaaggagggcgtggacagcgacagcgagttcaagttcaccctgtacaagaacgaccttctgctggtgaaggacaccgagaccaaggagcaacagctgttccgcttcctgagccgcaccatgcccaagcagaagcactacgtggagctgaagccctacgacaagcagaagttcgagggcggcgaggccctgatcaaggtgctgggcaacgtggccaacagcggccagtgcaagaagggcctgggcaagagcaacatcagcatctacaaggtgcgcaccgacgtgctgggcaaccagcacatcatcaagaacgagggcgacaagcccaagttggacttcagcagggctgaccccaagaagaagaggaaggtgtga

SEQ ID NO: 17 - DNA, 3264 bp, Artificial Sequence
  Description of Artificial Sequence: Synthetic polynucleotide
atggggaaacggaactacatcctggggcttgacattgggataaccagcgttggctacggaattattgattatgagacacgcgatgtgattgacgccggggttaggctgttcaaagaggccaacgttgaaaacaacgagggaagacggagtaagcgcggagcaagaagactcaagcgcagacggagacatcggattcagagggtgaaaaagctgctcttcgattacaatctcctgaccgatcatagtgagctgagcggaatcaacccctacgaggcgcgagtgaaagggctttcccagaagctgtccgaagaggagttctccgccgcgttgctgcacctggccaaacggaggggggttcacaatgtaaacgaagtggaggaggacacgggcaatgaacttagtacgaaagaacagatcagtaggaactctaaggctctcgaagagaaatacgtcgctgagttgcagcttgagagactgaaaaaagacggcgaagtacgcggatctattaataggttcaagacttcagattacgtaaaggaagccaagcagctcctgaaagtacagaaagcgtaccatcagctcgatcagagcttcatcgatacctacatagatttgctggagacacggaggacatactacgagggcccaggggaaggatctccttttgggtggaaggacatcaaggaatggtacgagatgcttatgggacattgtacatattttccggaggagctcaggagcgtcaagtacgcctacaatgccgacctgtacaatgccctcaatgacctcaataacctcgtgattaccagggacgagaacgagaagctggagtactatgaaaagttccagattatcgagaatgtgtttaagcagaagaagaagccgacacttaagcagattgcaaaggaaatcctcgtgaatgaggaagatatcaagggatacagagtgacaagtacaggcaagcccgagttcacaaatctgaaggtgtaccacgatattaaggacataaccgcacgaaaggagataatcgaaaacgctgagctcctcgatcagatcgcaaaaattcttaccatctaccagtctagtgaggacattcaggaggaactgactaatctgaacagtgagctcacccaagaggaaattgagcagatttcaaacctgaaaggctacaccgggacgcacaatctgagcctcaaagcaatcaacctcattctggatgaactttggcacacaaatgacaaccaaattgccatattcaaccgcctgaaactggtgccaaaaaaagtggatctgtcacagcaaaaggaaatccctacaaccttggttgacgattttattctgtcccccgttgtcaagcggagcttcatccagtcaatcaaggtgatcaatgccatcattaaaaaatacggattgccaaacgatataattatcgagcttgcacgagagaagaactcaaaggacgcccagaagatgattaacgaaatgcagaagcgcaaccgccagacaaacgaacgcatagaggaaattataagaacaaccggcaaagagaatgccaagtatctgatcgagaaaatcaagctgcacgacatgcaagaaggcaagtgcctgtactctctggaagctatcccactcgaagatctgctgaataatccattcaattacgaggtggaccacatcatccctagatccgtaagctttgacaattccttcaataacaaagttctggttaaacaggaggaaaattctaaaaaagggaaccggaccccgttccagtacctgagctccagtgacagcaagattagctacgagacttttaagaaacatattctgaatctggccaaaggcaaaggcaggatcagcaagaccaagaaggagtacctcctcgaagaacgcgacattaacagatttagtgtgcagaaagatttcatcaaccgaaaccttgtcgatactcggtacgccacgagaggcctgatgaatctcctcaggagctacttccgcgtcaataatctggacgttaaagtcaagagcataaatgggggattcaccagctttctgaggagaaagtggaagtttaagaaggaacgaaacaaaggatacaagcaccatgctgaggatgctttgatcatcgctaacgcggactttatctttaaggaatggaaaaagctggataaggcaaagaaagtgatggaaaaccagatgttcgaggagaagcaggcagagtcaatgcctgagatcgagacagagcaggaatacaaggaaattttcatcacccctcatcagattaaacacataaaggacttcaaagactataaatactctcatagggtggacaaaaaacccaatcgcgagctcattaatgacaccctgtactcaacacggaaggatgataaaggtaataccttgattgtgaataatcttaatggattgtatgacaaagataacgacaagctcaagaagctgatcaacaagtctccagagaagctccttatgtatcaccacgacccacagacttatcagaaattgaaactgatcatggagcaatacggggatgagaagaacccactctacaaatattatgaggaaacaggtaattacctgaccaagtactccaagaaggataacggaccagtgatcaaaaagataaagtactatggcaacaaacttaatgcgcatttggacataactgacgattaccccaattctcgaaacaaggttgtgaagctctccctgaagccttatagatttgacgtgtacctggataatggggtttataaattcgtcaccgtgaaaaatctggacgtgatcaaaaaggagaactattatgaagtaaactcaaagtgctatgaggaggcgaagaagctgaagaagatctccaatcaggccgagttcatcgcttccttctataataacgatctcatcaagatcaatggagagctttatcgcgtcattggtgtgaacaatgacttgctgaacaggatcgaagtcaatatgatagacattacctaccgggagtatctcgaaaacatgaatgataaacggccgcctcgcatcatcaagacaatcgcatctaaaactcagtcaataaaaaagtactctaccgatatcctggggaatctctatgaagtgaagtcaaagaagcacccacaaatcattaaaaaaggtggatcccccaagaagaagaggaaagtctcgagcgactacaaagaccatgacggtgattataaagatcatgacatcgattacaaggatgacgatgacaagtaa

SEQ ID NO: 18 - DNA, 422 bp, Artificial Sequence
  Description of Artificial Sequence: Synthetic polynucleotide
tgtacaaaaaagcaggctttaaaggaaccaattcagtcgactggatccggtaccaaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccggagacgattaatgcgtctccgttttagagctagaaatagcaagttaaaataaggctagtccgttatcaacttgaaaaagtggcaccgagtcggtgcttttttt

SEQ ID NO: 19 - DNA, 471 bp, Artificial Sequence
  Description of Artificial Sequence: Synthetic polynucleotide
tgtacaaaaaagcaggctttaaaggaaccaattcagtcgactggatccggtaccaaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacacccgagacgattaatgcgtctcggtttttgtactctcaagatttaagtaactgtacaacgaaacttacacagttacttaaatcttgcagaagctacaaagataaggcttcatgccgaaatcaacaccctgtcattttatggcagggtgttttttt

SEQ ID NO: 20 - DNA, 466 bp, Artificial Sequence
  Description of Artificial Sequence: Synthetic polynucleotide
tgtacaaaaaagcaggctttaaaggaaccaattcagtcgactggatccggtaccaaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacacccgagacgattaatgcgtctcggttttagtactctgtaattttaggtatgaggtagacgaaaattgtacttatacctaaaattacagaatctactaaaacaaggcaaaatgccgtgtttatctcgtcaacttgttggcgagattttttt

SEQ ID NO: 21 - DNA, 3609 bp, Artificial Sequence
  Description of Artificial Sequence: Synthetic polynucleotide
taatacgactcactataggggaattgtgagcggataacaattcccctgtagaaataattttgtttaactttaataaggagatataccatgggcaaacggaactacatcctggggcttgacattgggataaccagcgttggctacggaattattgattatgagacacgcgatgtgattgacgccggggttaggctgttcaaagaggccaacgttgaaaacaacgagggaagacggagtaagcgcggagcaagaagactcaagcgcagacggagacatcggattcagagggtgaaaaagctgctcttcgattacaatctcctgaccgatcatagtgagctgagcggaatcaacccctacgaggcgcgagtgaaagggctttcccagaagctgtccgaagaggagttctccgccgcgttgctgcacctggccaaacggaggggggttcacaatgtaaacgaagtggaggaggacacgggcaatgaacttagtacgaaagaacagatcagtaggaactctaaggctctcgaagagaaatacgtcgctgagttgcagcttgagagactgaaaaaagacggcgaagtacgcggatctattaataggttcaagacttcagattacgtaaaggaagccaagcagctcctgaaagtacagaaagcgtaccatcagctcgatcagagcttcatcgatacctacatagatttgctggagacacggaggacatactacgagggcccaggggaaggatctccttttgggtggaaggacatcaaggaatggtacgagatgcttatgggacattgtacatattttccggaggagctcaggagcgtcaagtacgcctacaatgccgacctgtacaatgccctcaatgacctcaataacctcgtgattaccagggacgagaacgagaagctggagtactatgaaaagttccagattatcgagaatgtgtttaagcagaagaagaagccgacacttaagcagattgcaaaggaaatcctcgtgaatgaggaagatatcaagggatacagagtgacaagtacaggcaagcccgagttcacaaatctgaaggtgtaccacgatattaaggacataaccgcacgaaaggagataatcgaaaacgctgagctcctcgatcagatcgcaaaaattcttaccatctaccagtctagtgaggacattcaggaggaactgactaatctgaacagtgagctcacccaagaggaaattgagcagatttcaaacctgaaaggctacaccgggacgcacaatctgagcctcaaagcaatcaacctcattctggatgaactttggcacacaaatgacaaccaaattgccatattcaaccgcctgaaactggtgccaaaaaaagtggatctgtcacagcaaaaggaaatccctacaaccttggttgacgattttattctgtcccccgttgtcaagcggagcttcatccagtcaatcaaggtgatcaatgccatcattaaaaaatacggattgccaaacgatataattatcgagcttgcacgagagaagaactcaaaggacgcccagaagatgattaacgaaatgcagaagcgcaaccgccagacaaacgaacgcatagaggaaattataagaacaaccggcaaagagaatgccaagtatctgatcgagaaaatcaagctgcacgacatgcaagaaggcaagtgcctgtactctctggaagctatcccactcgaagatctgctgaataatccattcaattacgaggtggaccacatcatccctagatccgtaagctttgacaattccttcaataacaaagttctggttaaacaggaggaaaattctaaaaaagggaaccggaccccgttccagtacctgagctccagtgacagcaagattagctacgagacttttaagaaacatattctgaatctggccaaaggcaaaggcaggatcagcaagaccaagaaggagtacctcctcgaagaacgcgacattaacagatttagtgtgcagaaagatttcatcaaccgaaaccttgtcgatactcggtacgccacgagaggcctgatgaatctcctcaggagctacttccgcgtcaataatctggacgttaaagtcaagagcataaatgggggattcaccagctttctgaggagaaagtggaagtttaagaaggaacgaaacaaaggatacaagcaccatgctgaggatgctttgatcatcgctaacgcggactttatctttaaggaatggaaaaagctggataaggcaaagaaagtgatggaaaaccagatgttcgaggagaagcaggcagagtcaatgcctgagatcgagacagagcaggaatacaaggaaattttcatcacccctcatcagattaaacacataaaggacttcaaagactataaatactctcatagggtggacaaaaaacccaatcgcgagctcattaatgacaccctgtactcaacacggaaggatgataaaggtaataccttgattgtgaataatcttaatggattgtatgacaaagataacgacaagctcaagaagctgatcaacaagtctccagagaagctccttatgtatcaccacgacccacagacttatcagaaattgaaactgatcatggagcaatacggggatgagaagaacccactctacaaatattatgaggaaacaggtaattacctgaccaagtactccaagaaggataacggaccagtgatcaaaaagataaagtactatggcaacaaacttaatgcgcatttggacataactgacgattaccccaattctcgaaacaaggttgtgaagctctccctgaagccttatagatttgacgtgtacctggataatggggtttataaattcgtcaccgtgaaaaatctggacgtgatcaaaaaggagaactattatgaagtaaactcaaagtgctatgaggaggcgaagaagctgaagaagatctccaatcaggccgagttcatcgcttccttctataataacgatctcatcaagatcaatggagagctttatcgcgtcattggtgtgaacaatgacttgctgaacaggatcgaagtcaatatgatagacattacctaccgggagtatctcgaaaacatgaatgataaacggccgcctcgcatcatcaagacaatcgcatctaaaactcagtcaataaaaaagtactctaccgatatcctggggaatctctatgaagtgaagtcaaagaagcacccacaaatcattaaaaaaggtggatcccccaagaagaagaggaaagtctcgagcgactacaaagaccatgacggtgattataaagatcatgacatcgattacaaggatgacgatgacaagtaaagcggccgcataatgcttaagtcgaacagaaagtaatcgtattgtacacggccgcataatcgaaattaatacgactcactataggggcacgggcagcttgccgggttttagtactctgtaatgaaaattacagaatctactaaaacaaggcaaaatgccgtgtttatctcgtcaacttgttggcgagattttttttccgctgagcaataactagcataaccccttggggcctctaaacgggtcttgaggggttttttg

SEQ ID NO: 22 - DNA, 3609 bp, Artificial Sequence
  Description of Artificial Sequence: Synthetic polynucleotide
taatacgactcactataggggaattgtgagcggataacaattcccctgtagaaataattttgtttaactttaataaggagatataccatgggcaaacggaactacatcctggggcttgccattgggataaccagcgttggctacggaattattgattatgagacacgcgatgtgattgacgccggggttaggctgttcaaagaggccaacgttgaaaacaacgagggaagacggagtaagcgcggagcaagaagactcaagcgcagacggagacatcggattcagagggtgaaaaagctgctcttcgattacaatctcctgaccgatcatagtgagctgagcggaatcaacccctacgaggcgcgagtgaaagggctttcccagaagctgtccgaagaggagttctccgccgcgttgctgcacctggccaaacggaggggggttcacaatgtaaacgaagtggaggaggacacgggcaatgaacttagtacgaaagaacagatcagtaggaactctaaggctctcgaagagaaatacgtcgctgagttgcagcttgagagactgaaaaaagacggcgaagtacgcggatctattaataggttcaagacttcagattacgtaaaggaagccaagcagctcctgaaagtacagaaagcgtaccatcagctcgatcagagcttcatcgatacctacatagatttgctggagacacggaggacatactacgagggcccaggggaaggatctccttttgggtggaaggacatcaaggaatggtacgagatgcttatgggacattgtacatattttccggaggagctcaggagcgtcaagtacgcctacaatgccgacctgtacaatgccctcaatgacctcaataacctcgtgattaccagggacgagaacgagaagctggagtactatgaaaagttccagattatcgagaatgtgtttaagcagaagaagaagccgacacttaagcagattgcaaaggaaatcctcgtgaatgaggaagatatcaagggatacagagtgacaagtacaggcaagcccgagttcacaaatctgaaggtgtaccacgatattaaggacataaccgcacgaaaggagataatcgaaaacgctgagctcctcgatcagatcgcaaaaattcttaccatctaccagtctagtgaggacattcaggaggaactgactaatctgaacagtgagctcacccaagaggaaattgagcagatttcaaacctgaaaggctacaccgggacgcacaatctgagcctcaaagcaatcaacctcattctggatgaactttggcacacaaatgacaaccaaattgccatattcaaccgcctgaaactggtgccaaaaaaagtggatctgtcacagcaaaaggaaatccctacaaccttggttgacgattttattctgtcccccgttgtcaagcggagcttcatccagtcaatcaaggtgatcaatgccatcattaaaaaatacggattgccaaacgatataattatcgagcttgcacgagagaagaactcaaaggacgcccagaagatgattaacgaaatgcagaagcgcaaccgccagacaaacgaacgcatagaggaaattataagaacaaccggcaaagagaatgccaagtatctgatcgagaaaatcaagctgcacgacatgcaagaaggcaagtgcctgtactctctggaagctatcccactcgaagatctgctgaataatccattcaattacgaggtggacgccatcatccctagatccgtaagctttgacaattccttcaataacaaagttctggttaaacaggaggaaaattctaaaaaagggaaccggaccccgttccagtacctgagctccagtgacagcaagattagctacgagacttttaagaaacatattctgaatctggccaaaggcaaaggcaggatcagcaagaccaagaaggagtacctcctcgaagaacgcgacattaacagatttagtgtgcagaaagatttcatcaaccgaaaccttgtcgatactcggtacgccacgagaggcctgatgaatctcctcaggagctacttccgcgtcaataatctggacgttaaagtcaagagcataaatgggggattcaccagctttctgaggagaaagtggaagtttaagaaggaacgaaacaaaggatacaagcaccatgctgaggatgctttgatcatcgctaacgcggactttatctttaaggaatggaaaaagctggataaggcaaagaaagtgatggaaaaccagatgttcgaggagaagcaggcagagtcaatgcctgagatcgagacagagcaggaatacaaggaaattttcatcacccctcatcagattaaacacataaaggacttcaaagactataaatactctcatagggtggacaaaaaacccaatcgcgagctcattaatgacaccctgtactcaacacggaaggatgataaaggtaataccttgattgtgaataatcttaatggattgtatgacaaagataacgacaagctcaagaagctgatcaacaagtctccagagaagctccttatgtatcaccacgacccacagacttatcagaaattgaaactgatcatggagcaatacggggatgagaagaacccactctacaaatattatgaggaaacaggtaattacctgaccaagtactccaagaaggataacggaccagtgatcaaaaagataaagtactatggcaacaaacttaatgcgcatttggacataactgacgattaccccaattctcgaaacaaggttgtgaagctctccctgaagccttatagatttgacgtgtacctggataatggggtttataaattcgtcaccgtgaaaaatctggacgtgatcaaaaaggagaactattatgaagtaaactcaaagtgctatgaggaggcgaagaagctgaagaagatctccaatcaggccgagttcatcgcttccttctataataacgatctcatcaagatcaatggagagctttatcgcgtcattggtgtgaacaatgacttgctgaacaggatcgaagtcaatatgatagacattacctaccgggagtatctcgaaaacatgaatgataaacggccgcctcgcatcatcaagacaatcgcatctaaaactcagtcaataaaaaagtactctaccgatatcctggggaatctctatgaagtgaagtcaaagaagcacccacaaatcattaaaaaaggtggatcccccaagaagaagaggaaagtctcgagcgactacaaagaccatgacggtgattataaagatcatgacatcgattacaaggatgacgatgacaagtaaagcggccgcataatgcttaagtcgaacagaaagtaatcgtattgtacacggccgcataatcgaaattaatacgactcactataggggcacgggcagcttgccgggttttagtactctgtaatgaaaattacagaatctactaaaacaaggcaaaatgccgtgtttatctcgtcaacttgttggcgagattttttttccgctgagcaataactagcataaccccttggggcctctaaacgggtcttgaggggttttttg

SEQ ID NO: 23 - DNA, 3609 bp, Artificial Sequence
  Description of Artificial Sequence: Synthetic polynucleotide
taatacgactcactataggggaattgtgagcggataacaattcccctgtagaaataattttgtttaactttaataaggagatataccatgggcaaacggaactacatcctggggcttgacattgggataaccagcgttggctacggaattattgattatgagacacgcgatgtgattgacgccggggttaggctgttcaaagaggccaacgttgaaaacaacgagggaagacggagtaagcgcggagcaagaagactcaagcgcagacggagacatcggattcagagggtgaaaaagctgctcttcgattacaatctcctgaccgatcatagtgagctgagcggaatcaacccctacgaggcgcgagtgaaagggctttcccagaagctgtccgaagaggagttctccgccgcgttgctgcacctggccaaacggaggggggttcacaatgtaaacgaagtggaggaggacacgggcaatgaacttagtacgaaagaacagatcagtaggaactctaaggctctcgaagagaaatacgtcgctgagttgcagcttgagagactgaaaaaagacggcgaagtacgcggatctattaataggttcaagacttcagattacgtaaaggaagccaagcagctcctgaaagtacagaaagcgtaccatcagctcgatcagagcttcatcgatacctacatagatttgctggagacacggaggacatactacgagggcccaggggaaggatctccttttgggtggaaggacatcaaggaatggtacgagatgcttatgggacattgtacatattttccggaggagctcaggagcgtcaagtacgcctacaatgccgacctgtacaatgccctcaatgacctcaataacctcgtgattaccagggacgagaacgagaagctggagtactatgaaaagttccagattatcgagaatgtgtttaagcagaagaagaagccgacacttaagcagattgcaaaggaaatcctcgtgaatgaggaagatatcaagggatacagagtgacaagtacaggcaagcccgagttcacaaatctgaaggtgtaccacgatattaaggacataaccgcacgaaaggagataatcgaaaacgctgagctcctcgatcagatcgcaaaaattcttaccatctaccagtctagtgaggacattcaggaggaactgactaatctgaacagtgagctcacccaagaggaaattgagcagatttcaaacctgaaaggctacaccgggacgcacaatctgagcctcaaagcaatcaacctcattctggatgaactttggcacacaaatgacaaccaaattgccatattcaaccgcctgaaactggtgccaaaaaaagtggatctgtcacagcaaaaggaaatccctacaaccttggttgacgattttattctgtcccccgttgtcaagcggagcttcatccagtcaatcaaggtgatcaatgccatcattaaaaaatacggattgccaaacgatataattatcgagcttgcacgagagaagaactcaaaggacgcccagaagatgattaacgaaatgcagaagcgcaaccgccagacaaacgaacgcatagaggaaattataagaacaaccggcaaagagaatgccaagtatctgatcgagaaaatcaagctgcacgacatgcaagaaggcaagtgcctgtactctctggaagctatcccactcgaagatctgctgaataatccattcaattacgaggtggaccacatcatccctagatccgtaagctttgacaattccttcaataacaaagttctggttaaacaggaggaaaattctaaaaaagggaaccggaccccgttccagtacctgagctccagtgacagcaagattagctacgagacttttaagaaacatattctgaatctggccaaaggcaaaggcaggatcagcaagaccaagaaggagtacctcctcgaagaacgcgacattaacagatttagtgtgcagaaagatttcatcaaccgaaaccttgtcgatactcggtacgccacgagaggcctgatgaatctcctcaggagctacttccgcgtcaataatctggacgttaaagtcaagagcataaatgggggattcaccagctttctgaggagaaagtggaagtttaagaaggaacgaaacaaaggatacaagcaccatgctgaggatgctttgatcatcgctaacgcggactttatctttaaggaatggaaaaagctggataaggcaaagaaagtgatggaaaaccagatgttcgaggagaagcaggcagagtcaatgcctgagatcgagacagagcaggaatacaaggaaattttcatcacccctcatcagattaaacacataaaggacttcaaagactataaatactctcatagggtggacaaaaaacccaatcgcaagctcattaatgacaccctgtactcaacacggaaggatgataaaggtaataccttgattgtgaataatcttaatggattgtatgacaaagataacgacaagctcaagaagctgatcaacaagtctccagagaagctccttatgtatcaccacgacccacagacttatcagaaattgaaactgatcatggagcaatacggggatgagaagaacccactctacaaatattatgaggaaacaggtaattacctgaccaagtactccaagaaggataacggaccagtgatcaaaaagataaagtactatggcaacaaacttaatgcgcatttggacataactgacgattaccccaattctcgaaacaaggttgtgaagctctccctgaagccttatagatttgacgtgtacctggataatggggtttataaattcgtcaccgtgaaaaatctggacgtgatcaaaaaggagaactattatgaagtaaactcaaagtgctatgaggaggcgaagaagctgaagaagatctccaatcaggccgagttcatcgcttccttctataagaacgatctcatcaagatcaatggagagctttatcgcgtcattggtgtgaacaatgacttgctgaacaggatcgaagtcaatatgatagacattacctaccgggagtatctcgaaaacatgaatgataaacggccgcctcacatcatcaagacaatcgcatctaaaactcagtcaataaaaaagtactctaccgatatcctggggaatctctatgaagtgaagtcaaagaagcacccacaaatcattaaaaaaggtggatcccccaagaagaagaggaaagtctcgagcgactacaaagaccatgacggtgattataaagatcatgacatcgattacaaggatgacgatgacaagtaaagcggccgcataatgcttaagtcgaacagaaagtaatcgtattgtacacggccgcataatcgaaattaatacgactcactataggggcacgggcagcttgccgggttttagtactctgtaatgaaaattacagaatctactaaaacaaggcaaaatgccgtgtttatctcgtcaacttgttggcgagattttttttccgctgagcaataactagcataaccccttggggcctctaaacgggtcttgaggggttttttg

SEQ ID NO: 24 - DNA, 3609 bp, Artificial Sequence
  Description of Artificial Sequence: Synthetic polynucleotide
taatacgactcactataggggaattgtgagcggataacaattcccctgtagaaataattttgtttaactttaataaggagatataccatgggcaaacggaactacatcctggggcttgacattgggataaccagcgttggctacggaattattgattatgagacacgcgatgtgattgacgccggggttaggctgttcaaagaggccaacgttgaaaacaacgagggaagacggagtaagcgcggagcaagaagactcaagcgcagacggagacatcggattcagagggtgaaaaagctgctcttcgattacaatctcctgaccgatcatagtgagctgagcggaatcaacccctacgaggcgcgagtgaaagggctttcccagaagctgtccgaagaggagttctccgccgcgttgctgcacctggccaaacggaggggggttcacaatgtaaacgaagtggaggaggacacgggcaatgaacttagtacgaaagaacagatcagtaggaactctaaggctctcgaagagaaatacgtcgctgagttgcagcttgagagactgaaaaaagacggcgaagtacgcggatctattaataggttcaagacttcagattacgtaaaggaagccaagcagctcctgaaagtacagaaagcgtaccatcagctcgatcagagcttcatcgatacctacatagatttgctggagacacggaggacatactacgagggcccaggggaaggatctccttttgggtggaaggacatcaaggaatggtacgagatgcttatgggacattgtacatattttccggaggagctcaggagcgtcaagtacgcctacaatgccgacctgtacaatgccctcaatgacctcaataacctcgtgattaccagggacgagaacgagaagctggagtactatgaaaagttccagattatcgagaatgtgtttaagcagaagaagaagccgacacttaagcagattgcaaaggaaatcctcgtgaatgaggaagatatcaagggatacagagtgacaagtacaggcaagcccgagttcacaaatctgaaggtgtaccacgatattaaggacataaccgcacgaaaggagataatcgaaaacgctgagctcctcgatcagatcgcaaaaattcttaccatctaccagtctagtgaggacattcaggaggaactgactaatctgaacagtgagctcacccaagaggaaattgagcagatttcaaacctgaaaggctacaccgggacgcacaatctgagcctcaaagcaatcaacctcattctggatgaactttggcacacaaatgacaaccaaattgccatattcaaccgcctgaaactggtgccaaaaaaagtggatctgtcacagcaaaaggaaatccctacaaccttggttgacgattttattctgtcccccgttgtcaagcggagcttcatccagtcaatcaaggtgatcaatgccatcattaaaaaatacggattgccaaacgatataattatcgagcttgcacgagagaagaactcaaaggacgcccagaagatgattaacgaaatgcagaagcgcaaccgccagacaaacgaacgcatagaggaaattataagaacaaccggcaaagagaatgccaagtatctgatcgagaaaatcaagctgcacgacatgcaagaaggcaagtgcctgtactctctggaagctatcccactcgaagatctgctgaataatccattcaattacgaggtggaccacatcatccctagatccgtaagctttgacaattccttcaataacaaagttctggttaaacaggaggaaaattctaaaaaagggaaccggaccccgttccagtacctgagctccagtgacagcaagattagctacgagacttttaagaaacatattctgaatctggccaaaggcaaaggcaggatcagcaagaccaagaaggagtacctcctcgaagaacgcgacattaacagatttagtgtgcagaaagatttcatcaaccgaaaccttgtcgatactcggtacgccacgagaggcctgatgaatctcctcaggagctacttccgcgtcaataatctggacgttaaagtcaagagcataaatgggggattcaccagctttctgaggagaaagtggaagtttaagaaggaacgaaacaaaggatacaagcaccatgctgaggatgctttgatcatcgctaacgcggactttatctttaaggaatggaaaaagctggataaggcaaagaaagtgatggaaaaccagatgttcgaggagaagcaggcagagtcaatgcctgagatcgagacagagcaggaatacaaggaaattttcatcacccctcatcagattaaacacataaaggacttcaaagactataaatactctcatagggtggacaaaaaacccaatcgcgagctcattaatgacaccctgtactcaacacggaaggatgataaaggtaataccttgattgtgaataatcttaatggattgtatgacaaagataacgacaagctcaagaagctgatcaacaagtctccagagaagctccttatgtatcaccacgacccacagacttatcagaaattgaaactgatcatggagcaatacggggatgagaagaacccactctacaaatattatgaggaaacaggtaattacctgaccaagtactccaagaaggataacggaccagtgatcaaaaagataaagtactatggcaacaaacttaatgcgcatttggacataactgacgattaccccaattctcgaaacaaggttgtgaagctctccctgaagccttatagatttgacgtgtacctggataatggggtttataaattcgtcaccgtgaaaaatctggacgtgatcaaaaaggagaactattatgaagtaaactcaaagtgctatgaggaggcgaagaagctgaagaagatctccaatcaggccgagttcatcgcttccttctataataacgatctcatcaagatcaatggagagctttatcgcgtcattggtgtgaacaatgacttgctgaacaggatcgaagtcaatatgatagacattacctaccgggagtatctcgaaaacatgaatgataaacggccgcctcgcatcatcaagacaatcgcatctaaaactcagtcaataaaaaagtactctaccgatatcctggggaatctctatgaagtgaagtcaaagaagcacccacaaatcattaaaaaaggtggatcccccaagaagaagaggaaagtctcgagcgactacaaagaccatgacggtgattataaagatcatgacatcgattacaaggatgacgatgacaagtaaagcggccgcataatgcttaagtcgaacagaaagtaatcgtattgtacacggccgcataatcgaaattaatacgactcactataggtcgccctcgaacttcacctgttttagtactctgtaatgaaaattacagaatctactaaaacaaggcaaaatgccgtgtttatctcgtcaacttgttggcgagattttttttccgctgagcaataactagcataaccccttggggcctctaaacgggtcttgaggggttttttg

SEQ ID NO: 25 - DNA, 3609 bp, Artificial Sequence
  Description of Artificial Sequence: Synthetic polynucleotide
taatacgactcactataggggaattgtgagcggataacaattcccctgtagaaataattttgtttaactttaataaggagatataccatgggcaaacggaactacatcctggggcttgccattgggataaccagcgttggctacggaattattgattatgagacacgcgatgtgattgacgccggggttaggctgttcaaagaggccaacgttgaaaacaacgagggaagacggagtaagcgcggagcaagaagactcaagcgcagacggagacatcggattcagagggtgaaaaagctgctcttcgattacaatctcctgaccgatcatagtgagctgagcggaatcaacccctacgaggcgcgagtgaaagggctttcccagaagctgtccgaagaggagttctccgccgcgttgctgcacctggccaaacggaggggggttcacaatgtaaacgaagtggaggaggacacgggcaatgaacttagtacgaaagaacagatcagtaggaactctaaggctctcgaagagaaatacgtcgctgagttgcagcttgagagactgaaaaaagacggcgaagtacgcggatctattaataggttcaagacttcagattacgtaaaggaagccaagcagctcctgaaagtacagaaagcgtaccatcagctcgatcagagcttcatcgatacctacatagatttgctggagacacggaggacatactacgagggcccaggggaaggatctccttttgggtggaaggacatcaaggaatggtacgagatgcttatgggacattgtacatattttccggaggagctcaggagcgtcaagtacgcctacaatgccgacctgtacaatgccctcaatgacctcaataacctcgtgattaccagggacgagaacgagaagctggagtactatgaaaagttccagattatcgagaatgtgtttaagcagaagaagaagccgacacttaagcagattgcaaaggaaatcctcgtgaatgaggaagatatcaagggatacagagtgacaagtacaggcaagcccgagttcacaaatctgaaggtgtaccacgatattaaggacataaccgcacgaaaggagataatcgaaaacgctgagctcctcgatcagatcgcaaaaattcttaccatctaccagtctagtgaggacattcaggaggaactgactaatctgaacagtgagctcacccaagaggaaattgagcagatttcaaacctgaaaggctacaccgggacgcacaatctgagcctcaaagcaatcaacctcattctggatgaactttggcacacaaatgacaaccaaattgccatattcaaccgcctgaaactggtgccaaaaaaagtggatctgtcacagcaaaaggaaatccctacaaccttggttgacgattttattctgtcccccgttgtcaagcggagcttcatccagtcaatcaaggtgatcaatgccatcattaaaaaatacggattgccaaacgatataattatcgagcttgcacgagagaagaactcaaaggacgcccagaagatgattaacgaaatgcagaagcgcaaccgccagacaaacgaacgcatagaggaaattataagaacaaccggcaaagagaatgccaagtatctgatcgagaaaatcaagctgcacgacatgcaagaaggcaagtgcctgtactctctggaagctatcccactcgaagatctgctgaataatccattcaattacgaggtggacgccatcatccctagatccgtaagctttgacaattccttcaataacaaagttctggttaaacaggaggaaaattctaaaaaagggaaccggaccccgttccagtacctgagctccagtgacagcaagattagctacgagacttttaagaaacatattctgaatctggccaaaggcaaaggcaggatcagcaagaccaagaaggagtacctcctcgaagaacgcgacattaacagatttagtgtgcagaaagatttcatcaaccgaaaccttgtcgatactcggtacgccacgagaggcctgatgaatctcctcaggagctacttccgcgtcaataatctggacgttaaagtcaagagcataaatgggggattcaccagctttctgaggagaaagtggaagtttaagaaggaacgaaacaaaggatacaagcaccatgctgaggatgctttgatcatcgctaacgcggactttatctttaaggaatggaaaaagctggataaggcaaagaaagtgatggaaaaccagatgttcgaggagaagcaggcagagtcaatgcctgagatcgagacagagcaggaatacaaggaaattttcatcacccctcatcagattaaacacataaaggacttcaaagactataaatactctcatagggtggacaaaaaacccaatcgcgagctcattaatgacaccctgtactcaacacggaaggatgataaaggtaataccttgattgtgaataatcttaatggattgtatgacaaagataacgacaagctcaagaagctgatcaacaagtctccagagaagctccttatgtatcaccacgacccacagacttatcagaaattgaaactgatcatggagcaatacggggatgagaagaacccactctacaaatattatgaggaaacaggtaattacctgaccaagtactccaagaaggataacggaccagtgatcaaaaagataaagtactatggcaacaaacttaatgcgcatttggacataactgacgattaccccaattctcgaaacaaggttgtgaagctctccctgaagccttatagatttgacgtgtacctggataatggggtttataaattcgtcaccgtgaaaaatctggacgtgatcaaaaaggagaactattatgaagtaaactcaaagtgctatgaggaggcgaagaagctgaagaagatctccaatcaggccgagttcatcgcttccttctataataacgatctcatcaagatcaatggagagctttatcgcgtcattggtgtgaacaatgacttgctgaacaggatcgaagtcaatatgatagacattacctaccgggagtatctcgaaaacatgaatgataaacggccgcctcgcatcatcaagacaatcgcatctaaaactcagtcaataaaaaagtactctaccgatatcctggggaatctctatgaagtgaagtcaaagaagcacccacaaatcattaaaaaaggtggatcccccaagaagaagaggaaagtctcgagcgactacaaagaccatgacggtgattataaagatcatgacatcgattacaaggatgacgatgacaagtaaagcggccgcataatgcttaagtcgaacagaaagtaatcgtattgtacacggccgcataatcgaaattaatacgactcactataggtcgccctcgaacttcacctgttttagtactctgtaatgaaaattacagaatctactaaaacaaggcaaaatgccgtgtttatctcgtcaacttgttggcgagattttttttccgctgagcaataactagcataaccccttggggcctctaaacgggtcttgaggggttttttg

SEQ ID NO: 26 - DNA, 3609 bp, Artificial Sequence
  Description of Artificial Sequence: Synthetic polynucleotide
taatacgactcactataggggaattgtgagcggataacaattcccctgtagaaataattttgtttaactttaataaggagatataccatgggcaaacggaactacatcctggggcttgacattgggataaccagcgttggctacggaattattgattatgagacacgcgatgtgattgacgccggggttaggctgttcaaagaggccaacgttgaaaacaacgagggaagacggagtaagcgcggagcaagaagactcaagcgcagacggagacatcggattcagagggtgaaaaagctgctcttcgattacaatctcctgaccgatcatagtgagctgagcggaatcaacccctacgaggcgcgagtgaaagggctttcccagaagctgtccgaagaggagttctccgccgcgttgctgcacctggccaaacggaggggggttcacaatgtaaacgaagtggaggaggacacgggcaatgaacttagtacgaaagaacagatcagtaggaactctaaggctctcgaagagaaatacgtcgctgagttgcagcttgagagactgaaaaaagacggcgaagtacgcggatctattaataggttcaagacttcagattacgtaaaggaagccaagcagctcctgaaagtacagaaagcgtaccatcagctcgatcagagcttcatcgatacctacatagatttgctggagacacggaggacatactacgagggcccaggggaaggatctccttttgggtggaaggacatcaaggaatggtacgagatgcttatgggacattgtacatattttccggaggagctcaggagcgtcaagtacgcctacaatgccgacctgtacaatgccctcaatgacctcaataacctcgtgattaccagggacgagaacgagaagctggagtactatgaaaagttccagattatcgagaatgtgtttaagcagaagaagaagccgacacttaagcagattgcaaaggaaatcctcgtgaatgaggaagatatcaagggatacagagtgacaagtacaggcaagcccgagttcacaaatctgaaggtgtaccacgatattaaggacataaccgcacgaaaggagataatcgaaaacgctgagctcctcgatcagatcgcaaaaattcttaccatctaccagtctagtgaggacattcaggaggaactgactaatctgaacagtgagctcacccaagaggaaattgagcagatttcaaacctgaaaggctacaccgggacgcacaatctgagcctcaaagcaatcaacctcattctggatgaactttggcacacaaatgacaaccaaattgccatattcaaccgcctgaaactggtgccaaaaaaagtggatctgtcacagcaaaaggaaatccctacaaccttggttgacgattttattctgtcccccgttgtcaagcggagcttcatccagtcaatcaaggtgatcaatgccatcattaaaaaatacggattgccaaacgatataattatcgagcttgcacgagagaagaactcaaaggacgcccagaagatgattaacgaaatgcagaagcgcaaccgccagacaaacgaacgcatagaggaaattataagaacaaccggcaaagagaatgccaagtatctgatcgagaaaatcaagctgcacgacatgcaagaaggcaagtgcctgtactctctggaagctatcccactcgaagatctgctgaataatccattcaattacgaggtggaccacatcatccctagatccgtaagctttgacaattccttcaataacaaagttctggttaaacaggaggaaaattctaaaaaagggaaccggaccccgttccagtacctgagctccagtgacagcaagattagctacgagacttttaagaaacatattctgaatctggccaaaggcaaaggcaggatcagcaagaccaagaaggagtacctcctcgaagaacgcgacattaacagatttagtgtgcagaaagatttcatcaaccgaaaccttgtcgatactcggtacgccacgagaggcctgatgaatctcctcaggagctacttccgcgtcaataatctggacgttaaagtcaagagcataaatgggggattcaccagctttctgaggagaaagtggaagtttaagaaggaacgaaacaaaggatacaagcaccatgctgaggatgctttgatcatcgctaacgcggactttatctttaaggaatggaaaaagctggataaggcaaagaaagtgatggaaaaccagatgttcgaggagaagcaggcagagtcaatgcctgagatcgagacagagcaggaatacaaggaaattttcatcacccctcatcagattaaacacataaaggacttcaaagactataaatactctcatagggtggacaaaaaacccaatcgcaagctcattaatgacaccctgtactcaacacggaaggatgataaaggtaataccttgattgtgaataatcttaatggattgtatgacaaagataacgacaagctcaagaagctgatcaacaagtctccagagaagctccttatgtatcaccacgacccacagacttatcagaaattgaaactgatcatggagcaatacggggatgagaagaacccactctacaaatattatgaggaaacaggtaattacctgaccaagtactccaagaaggataacggaccagtgatcaaaaagataaagtactatggcaacaaacttaatgcgcatttggacataactgacgattaccccaattctcgaaacaaggttgtgaagctctccctgaagccttatagatttgacgtgtacctggataatggggtttataaattcgtcaccgtgaaaaatctggacgtgatcaaaaaggagaactattatgaagtaaactcaaagtgctatgaggaggcgaagaagctgaagaagatctccaatcaggccgagttcatcgcttccttctataagaacgatctcatcaagatcaatggagagctttatcgcgtcattggtgtgaacaatgacttgctgaacaggatcgaagtcaatatgatagacattacctaccgggagtatctcgaaaacatgaatgataaacggccgcctcacatcatcaagacaatcgcatctaaaactcagtcaataaaaaagtactctaccgatatcctggggaatctctatgaagtgaagtcaaagaagcacccacaaatcattaaaaaaggtggatcccccaagaagaagaggaaagtctcgagcgactacaaagaccatgacggtgattataaagatcatgacatcgattacaaggatgacgatgacaagtaaagcggccgcataatgcttaagtcgaacagaaagtaatcgtattgtacacggccgcataatcgaaattaatacgactcactataggtcgccctcgaacttcacctgttttagtactctgtaatgaaaattacagaatctactaaaacaaggcaaaatgccgtgtttatctcgtcaacttgttggcgagattttttttccgctgagcaataactagcataaccccttggggcctctaaacgggtcttgaggggttttttg

SEQ ID NO: 27 - DNA, 3264 bp, Artificial Sequence
  Description of Artificial Sequence: Synthetic polynucleotide
atggggaaacggaactacatcctggggcttgacattgggataaccagcgttggctacggaattattgattatgagacacgcgatgtgattgacgccggggttaggctgttcaaagaggccaacgttgaaaacaacgagggaagacggagtaagcgcggagcaagaagactcaagcgcagacggagacatcggattcagagggtgaaaaagctgctcttcgattacaatctcctgaccgatcatagtgagctgagcggaatcaacccctacgaggcgcgagtgaaagggctttcccagaagctgtccgaagaggagttctccgccgcgttgctgcacctggccaaacggaggggggttcacaatgtaaacgaagtggaggaggacacgggcaatgaacttagtacgaaagaacagatcagtaggaactctaaggctctcgaagagaaatacgtcgctgagttgcagcttgagagactgaaaaaagacggcgaagtacgcggatctattaataggttcaagacttcagattacgtaaaggaagccaagcagctcctgaaagtacagaaagcgtaccatcagctcgatcagagcttcatcgatacctacatagatttgctggagacacggaggacatactacgagggcccaggggaaggatctccttttgggtggaaggacatcaaggaatggtacgagatgcttatgggacattgtacatattttccggaggagctcaggagcgtcaagtacgcctacaatgccgacctgtacaatgccctcaatgacctcaataacctcgtgattaccagggacgagaacgagaagctggagtactatgaaaagttccagattatcgagaatgtgtttaagcagaagaagaagccgacacttaagcagattgcaaaggaaatcctcgtgaatgaggaagatatcaagggatacagagtgacaagtacaggcaagcccgagttcacaaatctgaaggtgtaccacgatattaaggacataaccgcacgaaaggagataatcgaaaacgctgagctcctcgatcagatcgcaaaaattcttaccatctaccagtctagtgaggacattcaggaggaactgactaatctgaacagtgagctcacccaagaggaaattgagcagatttcaaacctgaaaggctacaccgggacgcacaatctgagcctcaaagcaatcaacctcattctggatgaactttggcacacaaatgacaaccaaattgccatattcaaccgcctgaaactggtgccaaaaaaagtggatctgtcacagcaaaaggaaatccctacaaccttggttgacgattttattctgtcccccgttgtcaagcggagcttcatccagtcaatcaaggtgatcaatgccatcattaaaaaatacggattgccaaacgatataattatcgagcttgcacgagagaagaactcaaaggacgcccagaagatgattaacgaaatgcagaagcgcaaccgccagacaaacgaacgcatagaggaaattataagaacaaccggcaaagagaatgccaagtatctgatcgagaaaatcaagctgcacgacatgcaagaaggcaagtgcctgtactctctggaagctatcccactcgaagatctgctgaataatccattcaattacgaggtggaccacatcatccctagatccgtaagctttgacaattccttcaataacaaagttctggttaaacaggaggaaaattctaaaaaagggaaccggaccccgttccagtacctgagctccagtgacagcaagattagctacgagacttttaagaaacatattctgaatctggccaaaggcaaaggcaggatcagcaagaccaagaaggagtacctcctcgaagaacgcgacattaacagatttagtgtgcagaaagatttcatcaaccgaaaccttgtcgatactcggtacgccacgagaggcctgatgaatctcctcaggagctacttccgcgtcaataatctggacgttaaagtcaagagcataaatgggggattcaccagctttctgaggagaaagtggaagtttaagaaggaacgaaacaaaggatacaagcaccatgctgaggatgctttgatcatcgctaacgcggactttatctttaaggaatggaaaaagctggataaggcaaagaaagtgatggaaaaccagatgttcgaggagaagcaggcagagtcaatgcctgagatcgagacagagcaggaatacaaggaaattttcatcacccctcatcagattaaacacataaaggacttcaaagactataaatactctcatagggtggacaaaaaacccaatcgcaagctcattaatgacaccctgtactcaacacggaaggatgataaaggtaataccttgattgtgaataatcttaatggattgtatgacaaagataacgacaagctcaagaagctgatcaacaagtctccagagaagctccttatgtatcaccacgacccacagacttatcagaaattgaaactgatcatggagcaatacggggatgagaagaacccactctacaaatattatgaggaaacaggtaattacctgaccaagtactccaagaaggataacggaccagtgatcaaaaagataaagtactatggcaacaaacttaatgcgcatttggacataactgacgattaccccaattctcgaaacaaggttgtgaagctctccctgaagccttatagatttgacgtgtacctggataatggggtttataaattcgtcaccgtgaaaaatctggacgtgatcaaaaaggagaactattatgaagtaaactcaaagtgctatgaggaggcgaagaagctgaagaagatctccaatcaggccgagttcatcgcttccttctataagaacgatctcatcaagatcaatggagagctttatcgcgtcattggtgtgaacaatgacttgctgaacaggatcgaagtcaatatgatagacattacctaccgggagtatctcgaaaacatgaatgataaacggccgcctcacatcatcaagacaatcgcatctaaaactcagtcaataaaaaagtactctaccgatatcctggggaatctctatgaagtgaagtcaaagaagcacccacaaatcattaaaaaaggtggatcccccaagaagaagaggaaagtctcgagcgactacaaagaccatgacggtgattataaagatcatgacatcgattacaaggatgacgatgacaagtaa

SEQ ID NO: 28 - DNA, 430 bp, Artificial Sequence
  Description of Artificial Sequence: Synthetic polynucleotide
tgtacaaaaaagcaggctttaaaggaaccaattcagtcgactggatccggtaccaaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacacccgagacgattaatgcgtctcggttttagtactctgtaatgaaaattacagaatctactaaaacaaggcaaaatgccgtgtttatctcgtcaacttgttggcgagattttttt

SEQ ID NO: 29 - protein, 134 aa, Listeria innocua
QQVLPNHLVTLLHHAANCEVSDGKSLDYIESNREMFAELLAHVSEFAKRYTLAEANLNKINQLFEQNKEGDIKAIAQSFVDLMAFNAMGAPASFKFFETTIERKRYNNLKELLNSTIIYQSITGLYESRKRLDD

SEQ ID NO: 30 - protein, 139 aa, Streptococcus mutans
EIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLNKLGGD

SEQ ID NO: 31 - protein, 148 aa, Streptococcus thermophilus
QIFLSQKFVKLLYHAKRISNTINENHRKYVENHKKEFEELFYYILEFNENYVGAKKNGKLLNSAFQSWQNHSIDELCSSFIGPTGSERKGLFELTSRGSAADFEFLGVKIPRYRDYTPSSLLKDATLIHQSVTGLYETRIDLAKLGEG

SEQ ID NO: 32 - protein, 175 aa, Francisella novicida
KRKTWDNNFIYQILNDSDSRADGTKPFIPAFDISKNEIVEAIIDSFTSKNIFWLPKNIELQKVDNKNIFAIDTSKWFEVETPSDLRDIGIATIQYKIDNNSRPKVRVKLDYVIDDDSKINYFMNHSLLKSRYPDKVLEILKQSTIIEFESSGFNKTIKEMLGMKLAGIYNETSNN

SEQ ID NO: 33 - protein, 145 aa, Lactobacillus buchneri
KQLVLSDKAMQVLSKDDKLKNQDENQNLIDVYDEILEKVDQYFELYDINKFRQKLHDGRKKFIELPVDNDFNGKKLISYGKRATIISILNGLHANATMSNLKYLGISSPFGMLQVPNGIILSPASRICYQSPTGLFERKVKLSDL

SEQ ID NO: 34 - protein, 155 aa, Trepanoma denticola
SQREKIGKTISPYEDLSFRSYIKENLWKKTKNDEIGEKEFYDLLQKKNLEIYDMLLTKHKDTIYKKRPNSATIDILVKGKEKFKSLIIENQFEVILEILKLFSATRNVSDLQHIGGSKYSGVAKIGNKISSLDNCILIYQSITGIFEKRIDLLKV

SEQ ID NO: 35 - protein, 150 aa, Streptococcus thermophilus
NKTTGKYEILGLKYADLQFEKGTGTYKISQEKYNDIKKKEGVDSDSEFKFTLYKNDLLLVKDTETKEQQLFRFLSRTMPKQKHYVELKPYDKQKFEGGEALIKVLGNVANSGQCKKGLGKSNISIYKVRTDVLGNQHIIKNEGDKPKLDF

SEQ ID NO: 36 - protein, 128 aa, Neisseria meningitidis
KGDKYYLVPIYSWQVAKGILPDRAVVQGKDEEDWQLIDDSFNFKFSLHPNDLVEVITKKARMFGYFASCHRGTGNINIRIHDLDHKIGKNGILEGIGVKTALSFQKYQIDELGKEIRPCRLKKRPPVR

SEQ ID NO: 37 - protein, 127 aa, Pasteurella multocida
KNNKFFLVPIYTWQVAKGILPNKAIVAHKNEDEWEEMDEGAKFKFSLFPNDLVELKTKKEYFFGYYIGLDRATGNISLKEHDGEISKGKDGVYRVGVKLALSFEKYQVDELGKNRQICRPQQRQPVR

SEQ ID NO: 38 - protein, 141 aa, Campylobacter jejuni
FYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 39 - protein, 148 aa, Actinomyces naeslundii
QRHGDLFSAVIPPQSISMRCAEPKLRKAITTGNATYLGWVVVGDELEINVDSFTKYAIGRFLEDFPNTTRWRICGYDTNSKLTLKPIVLAAEGLENPSSAVNEIVELKGWRVAINVLTKVHPTVVRRDALGRPRYSSRSNLPTSWTIE

SEQ ID NO: 40 - protein, 135 aa, Staphylococcus aureus
DNGVYKFVTVKNLDVIKKENYYEVNSKCYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKHPQIIKKG

SEQ ID NO: 41 - DNA, 6 bp, Artificial Sequence
  Description of Artificial Sequence: Synthetic oligonucleotide
  modified_base (1)..(2): a, c, t, g, unknown or other
nnaagt

SEQ ID NO: 42 - DNA, 6 bp, Artificial Sequence
  Description of Artificial Sequence: Synthetic oligonucleotide
  modified_base (1)..(2): a, c, t, g, unknown or other
nnaggt

SEQ ID NO: 43 - DNA, 6 bp, Artificial Sequence
  Description of Artificial Sequence: Synthetic oligonucleotide
  modified_base (1)..(2): a, c, t, g, unknown or other
nnarrt

SEQ ID NO: 44 - DNA, 6 bp, Artificial Sequence
  Description of Artificial Sequence: Synthetic oligonucleotide
  modified_base (1)..(2): a, c, t, g, unknown or other
nnhrrt

SEQ ID NO: 45 - DNA, 6 bp, Artificial Sequence
  Description of Artificial Sequence: Synthetic oligonucleotide
  modified_base (1)..(2): a, c, t, g, unknown or other
nnrrrt

SEQ ID NO: 46 - DNA, 6 bp, Artificial Sequence
  Description of Artificial Sequence: Synthetic oligonucleotide
  modified_base (1)..(2): a, c, t, g, unknown or other
nngrrt

SEQ ID NO: 47 - DNA, 6 bp, Artificial Sequence
  Description of Artificial Sequence: Synthetic oligonucleotide
  modified_base (1)..(2): a, c, t, g, unknown or other
nncrrt

SEQ ID NO: 48 - DNA, 6 bp, Artificial Sequence
  Description of Artificial Sequence: Synthetic oligonucleotide
  modified_base (1)..(2): a, c, t, g, unknown or other
nntrrt

SEQ ID NO: 49 - DNA, 6 bp, Artificial Sequence
  Description of Artificial Sequence: Synthetic oligonucleotide
  modified_base (1)..(2): a, c, t, g, unknown or other
  modified_base (6)..(6): a, c, t, g, unknown or other
nngrrn

SEQ ID NO: 50-52 - skipped (3 entries)

SEQ ID NO: 53 - protein, 402 aa, Artificial Sequence
  Description of Artificial Sequence: Synthetic polypeptide
ATRGLMNLLRSYFRVNNLDVKVKSINGGFTSFLRRKWKFKKERNKGYKHHAEDALIIANADFIFKEWKRLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVKSKCYEEAKKLKKISNQAEFIASFYNNDLIKINGELYRVIGVNNDLLNRIEVNMIDITYREYLENMNDKRPPHIIKTIASKTQSIKKYSTDILGNLYEVKSNKHPQIIKKG

SEQ ID NO: 54 - protein, 402 aa, Artificial Sequence
  Description of Artificial Sequence: Synthetic polypeptide
ATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKELINKSPEKLLMYHHDPQTYQKLKLIMEQYGDEKNPLYKYYEETGNYLTKYSKKDNGPVIKKIKYYGNKLNAHLDITDDYPNSRNMVVKLSLKPYRFDVYLDNGVYKFVTVKNLDVIKKENYYEVNSKCYEEAKKLKKISNQAEFMASFYKNDLIKFNGELYRVIGVNNDLLNRIEVNMIDITYREYLENMNDKRPPHIIKTIASKTQSIKKYSTDILGNLYEVKSKKHPQIIKKG

SEQ ID NO: 55 - protein, 402 aa, Artificial Sequence
  Description of Artificial Sequence: Synthetic polypeptide
ATRGLMNLLRSYFRVNNLDIKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLNITDDYPNSRNKVVKLSLKPYRFDVYLDNGVYKFVTVKNLDVIKKENYYEVNSKCYEEAKKLKKISNQAEFISSFYSNDLIKINGELYRVIGVNNDLLNRIEVNMIDITYREYLENMNDKRPPHIIKRIASKTQSIKKYSTDILGNLYEVKSKKHPQIIKKG

SEQ ID NO: 56 - protein, 402 aa, Artificial Sequence
  Description of Artificial Sequence: Synthetic polypeptide
ATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIVITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPHIIKTIASKTQSIKKYSTDILGNLYEVKSKKHPEIIKKG

SEQ ID NO: 57 - protein, 402 aa, Artificial Sequence
  Description of Artificial Sequence: Synthetic polypeptide
ATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIRINGELYRVIGVNNDLLNRIEVNMIDITYREYLENMNDKRPPHIIKTIASKTQSIKKYSTDILGNLYEVKSKKHPQIIKKG

SEQ ID NO: 58 - protein, 402 aa, Artificial Sequence
  Description of Artificial Sequence: Synthetic polypeptide
ATRGLMNLLRSYFRVNNLDVKVKSIKGGFTSFLRRKWKFKKERNKGYKHHAEDALIIANADFIFKEWKKLDKAKKVMENQMFEEKQAESMPEIETEQEYKEIFITPHQIKHIKDFKDFKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDNYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYRGYLENMNDKRPPHIIKTIASKTQSIKKYSTDILGNLYEVKSKKHPQIIKKG

SEQ ID NO: 59 - protein, 402 aa, Artificial Sequence
  Description of Artificial Sequence: Synthetic polypeptide
ATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMKDKRPPHIIKTIASKTQSIIKYSTDILGNLYEVKSKKHPQIIKKG

SEQ ID NO: 60 - protein, 402 aa, Artificial Sequence
  Description of Artificial Sequence: Synthetic polypeptide
ATRGLMNLLRSYFRVNNLDVKVKSINGGFTSFLRRKWKFKKERNKGYKHHAEDALIIANADFIFKEWKKLDKAKKVMENQMFEEKQAESMPEIETEHEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPHIIKTIASKTQSIKKYSTDILGNLYEVKSNKHPQIIKKG

SEQ ID NO: 61 - protein, 402 aa, Artificial Sequence
  Description of Artificial Sequence: Synthetic polypeptide
ATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHINDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPHIIKTIASKTQSIKKYSTDILGNLYEVKSKKRPQIIKKG

SEQ ID NO: 62 - protein, 402 aa, Artificial Sequence
  Description of Artificial Sequence: Synthetic polypeptide
ATRGLMNLLRSYFRVNNLDVKVKSINGGFTSFLRRKWKFKKERNKGYKHHAEDALIIANADFIFKEWKKLDKAKKLMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVRNLDVIKKENHYEVNSKCYEEAKKLKKISNQAEFIASFYNNDLIKINGELYRVIGVNNDLLNRIEVNMIDITYREYLENMNDKRPPQIIKTIASKTQSIKKYSTDILGNLYEVKSKKHPQIIKKG

SEQ ID NO: 63 - protein, 402 aa, Artificial Sequence
  Description of Artificial Sequence: Synthetic polypeptide
ATRGLMNLLRSYFRVNNLDVKVKSINGGFTSFLRRKWKFKKERNKGYKHHAEDALIIANADFIFKEWKKLDKAKKVMENQMFEEKQAESKPEIETEQEYKEIFITPHQIKHIKDFKDYKYSHRVDKKPNRKLINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNTKCYEEAKKLKKISNQAEFIASFYNNDLIKINGELYRVIGVNNDLLNRIEVNMIDITYREYLENMNDKRPPQIIKTIASKTQSIKKYSTDILGNLYEVKSKKHPQIVKKG

SEQ ID NO: 64 - protein, 402 aa, Artificial Sequence
  Description of Artificial Sequence: Synthetic polypeptide
ATRGLMNLLRSYFRVNNLDVKVKSINGGFTSFLRRKWKFKKERNKGYKHHAEDALIIANADFIFKEWKKLDRAKKVMENQMFEEKQAESMPEIETEQEYKEIFITPHQIKHIKDFKDYKYSHRVDKKPNRELINDTLYSTRKDDKGYTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPQIIKTITSKTQSIKKYSTDILGNLYEVKSKKQPQIIKKG

SEQ ID NO: 65 - protein, 402 aa, Artificial Sequence
  Description of Artificial Sequence: Synthetic polypeptide
ATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRKLINDTLYSTRKDDKGNTLIVNNLNGLYDKDNDKLKKLINKSPEKLLMYHHDPQTYQKLKLILEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPQIIKTIASKTQSIKKYSTDILGNLYEVKSKKHPQIIKKG

SEQ ID NO: 66 - protein, 402 aa, Artificial Sequence
  Description of Artificial Sequence: Synthetic polypeptide
ATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRKLINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGIYKFVTVKNMDVIKKENYYEVNSKCYEEAKKLKKISNQAEFIASFYNNDLIKINGELYRVIGVNNDLLNRIEVNMIDITYREYIENMNDKRPPQIIKTIASKTQSIKKYSTDILGNLYEVKSKKHPQIIKKG

SEQ ID NO: 67 - protein, 402 aa, Artificial Sequence
  Description of Artificial Sequence: Synthetic polypeptide
ATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVRNLDVIKKENYYEVNSKCYEEAKKLKKISNQAEFIASFYNNDLIKINGELYRVIGVNNDLLNRIEVNMIDITYREYLENMNDKRPPQIIKTIASKTQSIKKYSTDILGNLYEVKSKKHPQVIKKG

SEQ ID NO: 68 - protein, 400 aa, Artificial Sequence
  Description of Artificial Sequence: Synthetic polypeptide
ATRGLMNLLRSYFRVNNLDVKVKSINGGFTSFLRRKWKFKKERNKGYKHHAEDALIIANADFIFKEWKRLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDDKNPLYKYYEETGNYLIKYSKKDNGPVIKKIKYYGNKLNAHLDITDDYPNSRNKVVKLSLKPYRFDVYLDNGVYKFVTVRNLDVIKKENYYEVNSKCYEEAKKLKKISNQAEFIAYFYNNDLIKINGELYRVIGVNNDLLNRIEVNMIDITYREYLENMNDKRPPQIIKTIASKTQSIKKYSTDILGNLYEVKSKKHPQIIK

SEQ ID NO: 69 - protein, 402 aa, Artificial Sequence
  Description of Artificial Sequence: Synthetic polypeptide
ATRGLMNLLRSYFRVNNLDVKVKSINGGFTRFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRKLINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPQIIKTIASKTQSIKKYSTDILGNLYEVKSKKHPQITKKG

SEQ ID NO: 70 - protein, 399 aa, Artificial Sequence
  Description of Artificial Sequence: Synthetic polypeptide
ATRGLMNLLRNYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDQQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKNENYYEVNSKCYEEAKKLKKISNQAEFIASFYNNDLIKINGELYRVIGVNNDLLNRIEVNMIDITYREYLENMNDKRPPQNIKTIASKTQSIKKYSTDILGNLYEVKSKKHPQII

SEQ ID NO: 71 - protein, 402 aa, Artificial Sequence
  Description of Artificial Sequence: Synthetic polypeptide
ATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRKLINDTLYSTRKDDKGNTLIVNNLNGLYDKDNDKLKKLINKSPEKLLMYHHDPQTYQKLKLIMEQYGDEKNPLYKYYEETGYYLTKYSKKDNGPVIKKIKYYGNKINAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPQIIKTIASKTQSIKKYSTDILGNLYEVKSKKHPQIVKKG

SEQ ID NO: 72 - protein, 402 aa, Artificial Sequence
  Description of Artificial Sequence: Synthetic polypeptide
ATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPQIIKTIASKTQSIKKYSTDILGNLYEVKSKKHPQIIKKG

SEQ ID NO: 73 - protein, 402 aa, Artificial Sequence
  Description of Artificial Sequence: Synthetic polypeptide
ATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYKNDLIKINGELYRVIGVNNDLLNRIEVNMIDITYREYLENMNDKRPPQIIKTIASKTQSIKKYSTDILGNLYEVKSKKHPQIIKKG

SEQ ID NO: 74 - protein, 402 aa, Artificial Sequence
  Description of Artificial Sequence: Synthetic polypeptide
ATRGLMNLLRSYFRVNNLDVKVKSINGGFTSFLRRKWKFKKERNKGYKHHAEDALIIANADFIFKEWKKLDKAKKLMENQMFEEKQAESMPEIETEQEYKEIFMTPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYHEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPHIIKTIASKTQSIKKYSTDILGNLYEVKSKKHPQIIKKG

SEQ ID NO: 75 - protein, 396 aa, Artificial Sequence
  Description of Artificial Sequence: Synthetic polypeptide
ATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDIGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNYKRPPQIIKTIASKTQSIKKYSSDILGNLYEVKSKKHP

SEQ ID NO: 76 - protein, 402 aa, Artificial Sequence
  Description of Artificial Sequence: Synthetic polypeptide
ATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRKLINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPQIINTIASKTQSIKKYSTDILGNLYEVKSKKHPQIIKKG

SEQ ID NO: 77 - protein, 402 aa, Artificial Sequence
  Description of Artificial Sequence: Synthetic polypeptide
ATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKELFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYKNDLIKINGELYRVIGVNNDLLNRIEVNMIDITYREYLENMNDKRPPQIIKTIASKTQSIKKCSTDILGNLYEVKSKKHPQIIKKG

SEQ ID NO: 78 - protein, 402 aa, Artificial Sequence
  Description of Artificial Sequence: Synthetic polypeptide
ATRGLMNLLRSYFRVNNLDVKVKSINGGFTSFLRRKWKFKKERNKGYKHHAEDALIIANADFIFKEWKKLDKAKKVMENQMFEKKQAESMPEIETEQEYKEIFITPHQIKHIKDFKDYKYSHRVDKKPNRGLINDTLYSTRKDDKGNTLIVNNLNGLYDKDNDKLKKLINKSPEKLLMYHHDPQTYQKLKLIMEQYGDEKNPLYKYYEDTGNYLTKYSKKDNGPVIKKIKYYGNKLNAHLDITDDYPNSRNKVVKLSLKPYRFDVYLDNGVYKFVTVKNLDLIKKENYYEVNSKCYEEAKKLKKISNQAEFIASFYNNDLIKINGELYRVIGVNNDLLNRIEVNMIDITYREYLENVNDKRPPQIIKTIASKTQSIKKYSTDILGNLYEVKSKKHPQIIKKG

SEQ ID NO: 79 - protein, 402 aa, Artificial Sequence
  Description of Artificial Sequence: Synthetic polypeptide
ATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRKLINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGIYKFVTVKNLDVIKKENYYEVNSKCYEKAKKLKKISNQAEFIASFYNNDLIKINGELYRVIGVNNDLLNRIEVNMIDITYREYLENMNDKRPPQIIKTIASKTQSIKKYSTDILGNLYEVKSNKHPQIIKKG

SEQ ID NO: 80 - protein, 402 aa, Artificial Sequence
  Description of Artificial Sequence: Synthetic polypeptide
ATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFIIPHQIKHIKDFKDYKYSHRVDKKPNRKLINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPQIIKTIASKTQSIKKYSTDILGNLYEVKSKKHPQIIKKG

SEQ ID NO: 81 - protein, 402 aa, Artificial Sequence
  Description of Artificial Sequence: Synthetic polypeptide
ATRGLMNLLRSYFRVNNLDVKVKSINGGFTSFLRRKWKFKKERNKGYKHHAEDALIIANADFIFKEWKKLDKAKKVMENQMFEEKQAESMPEIETQQEYKEIFITPHQIKHIKDFKDYKYSHRVDKKPNRKLINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASYYNNDLIKINGELYRVIGVNNDLLNRIEVKMIDITYREYLENMNDKRPPQIIKTIASKTQSIKKYSTDILGNLYEVKSKKHPHIIKKG

SEQ ID NO: 82 - protein, 402 aa, Artificial Sequence
  Description of Artificial Sequence: Synthetic polypeptide
ATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRKLINDTLYSTRKDDKGNTLIVNILNGLYDKDNDKLKKLINKSPEKLLMYHHDPQTYQKLKLIMEQYGDEKNPLYKYYEETGNYLTKYSKKDNGPVIKKIRYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPQIIKTIASKTQSIKKYSTDILGNLYEVKSKKHPQIIKKG

SEQ ID NO: 83 - protein, 402 aa, Artificial Sequence
  Description of Artificial Sequence: Synthetic polypeptide
ATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRKLINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYFENMNVKRPPQIIKTIASKTQSIKKYSTDILGNLYEVKSKKHPQIIKKG

SEQ ID NO: 84 - protein, 402 aa, Artificial Sequence
  Description of Artificial Sequence: Synthetic polypeptide
ATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKHNRELVNDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPQIIKTITSKTQSIKKYSTDILGNLYEVKSKKHPQIIKKG

SEQ ID NO: 85 - protein, 402 aa, Artificial Sequence
  Description of Artificial Sequence: Synthetic polypeptide
ATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIMDFKDYKYSHRVDKKPNRELINDTLYSTRKDEKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVRNLDVIKKENYYEVNSKCYEEAKKLKKISNQAEFIASFYNNDLIKINGELYRVIGVNNDLLNRIEVNMIDITYREYLENMNDKRPPQIIKTIASKTQSIKKYSTDILGNLYEVKSKKHPQIIKKG

SEQ ID NO: 86 - protein, 402 aa, Artificial Sequence
  Description of Artificial Sequence: Synthetic polypeptide
ATRGLMNLLRSYFRVNNLDVKVKSINGGFTSFLRRKWKFKKERNKGYKHHAEDALIIANADFIFKEWKKLDKAKKVMENQMFEEKQAVSMPEIETEQEYKEIFINPHQIKHIKDFKDYKYSHRVDKKPNRELINDTLYSTRKDDKGNTLIVNNLNGLYDKYNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSRKPYRFDVYLDNGVYKFVTVKNLDVIKKENYYEVNSKCYEEAKKLKKISNQAEFIASFYNNDLIKINGELYRVIGVNNDLLNRIEVNMIDITYREYRENMNDKRPPQIIKTIASKTQSIKKYSTDILGNLYEVKSKKHPQIIKKG

SEQ ID NO: 87 - protein, 402 aa, Artificial Sequence
  Description of Artificial Sequence: Synthetic polypeptide
ATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKNENYYEVNSKCYEEAKKLKKISNQAEFIASFYNNDLIKINGELYRVIGVNNDLLNRIEVNMIDITYREYLENINGKRPPQIIKTITSKTQSIKKYSTDILGNLYEVKSKKHPQIIKKG

SEQ ID NO: 88 - protein, 402 aa, Artificial Sequence
  Description of Artificial Sequence: Synthetic polypeptide
ATRGLMNLLRSYFRVNNLDVKVKSINGGFTSFLRRKWKFKKERNNGYKHHAEDALIIANADFIFKEWKKLDKAKKVMENQMFEEKQAESMPEIETEQEYKEIFITPHQIKHIKEFKDYKYSHRVDKKPNRKLINDTLYSTRKDDKGNTLIVNNLNGLYDKDNDKLKKLINKSPEKLLMYHHDPQTYQKLKLIMEQYGDEKNPLYKYYEETGIYLTKYSKKDNGPVIKKIKYYGNKLNAHLDITDDYPNSRNKVVKLSLKPYRFDVYLDNGVYKFVTVKNLDVIKKENYYEVNSKCYGEAKKLKKISNQAEFIASFYNNDLIKINGELYRVIGVNNDLLNRIEVNMIDITYREYLEIMNDKRPPQIIKTIASKTQSIKKYSTDILGNLYEVKSNKHPQIIKKG

SEQ ID NO: 89 - protein, 402 aa, Artificial Sequence
  Description of Artificial Sequence: Synthetic polypeptide
ATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKVIFITPHQIKHIKDFKDYKYSHRVDKKPNRKLINDTLYSTRKDDKGNTLIVNNLNGLYDKDNDKLKKLINKSPEKLLMYHHDPQTYQKLKLIMEQYGDEKNPLYIYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPQIIKTIASKTQSIKKYSTDILGNVYEVKSKKHPQIIIKG

SEQ ID NO: 90 - protein, 402 aa, Artificial Sequence
  Description of Artificial Sequence: Synthetic polypeptide
ATRGLMNLLRSYFRVNNLDVKVKSINGGFTSFLRRKWKFKKERNKGYKHHAEDALIIANADFIFKEWKKLDKAKKVMENQMFEEKQAESMPEIETGQEYKEIFITPHQIKHIKDFKDYKYSHRVDKKPNRKLINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPQIIKTIASKTQSIKKYSTDILGNLYEVKSKKHPQIIKKG

SEQ ID NO: 91 - protein, 402 aa, Artificial Sequence
  Description of Artificial Sequence: Synthetic polypeptide
ATRGLMNLLKSYFRVNNLDVKVKSINGGFTSFLRRKWKFKKERNKGYKHHAEDALIIANADFIFKEWKKLDKSKKVMENQMFEEKQAESMPEIETEQEYKEIFITPHQIKHIKDFKDYKYSHRVDKKHNRKLINDTLYSTRKDDKGNTLIVNNINGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNTIDITYREYLENMNDKRPPQIIKTIASKTQSIKKYSTDILGNLYEVKPKKHPQIIKKG

SEQ ID NO: 92 - protein, 396 aa, Artificial Sequence
  Description of Artificial Sequence: Synthetic polypeptide
ATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRKLINDTLYSTREDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDISDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIYITYREYLENMNDKRPPQIIKTIASKTQSIKKYSTDILGNLYEVKSKKHP

SEQ ID NO: 93 - protein, 402 aa, Artificial Sequence
  Description of Artificial Sequence: Synthetic polypeptide
ATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPYQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVRNLDVIKKENYYEVNSKCYEEAKKLKKISNQAEFIASFYNNDLIKINGELYRVIGVNNDLLNRIEVNMIDITYREYLENMNDKRPPQIIKTIASKTQSIKKYSTDILGNLYEVKSKKHPQIIKKG

SEQ ID NO: 94 - protein, 402 aa, Artificial Sequence
  Description of Artificial Sequence: Synthetic polypeptide
ATRGLMNLLRSYFRVNNLDVKVKSINGGFTSFLRRKWKFKKERNKGYKHHAEDALIIANADFIFKEWKKLDNAKKVMENQMFEEKRAESMPEIETEQEYKEIFITPHQIKHIKDFKDFKYSHMVDKKPNRKLINDTLYSTRKDDKGNTLIVNNLNGLYDKDNDKLKKLINKSPEKLLIYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPQIIKTIASKTQSIKKYSTDILGNLYEVKSKKHPQIIKKG

SEQ ID NO: 95 - protein, 396 aa, Artificial Sequence
  Description of Artificial Sequence: Synthetic polypeptide
ATRGLMNLLRSYFRVNNLDVKVKSINGGFTSFLRRKWKFKKERNKGYKHHAEDALIIANADFIFKEWIRLDKAKKVMENQMFEEKQAESMPEIETEQEYKEIFITPHQIKHIKDFKDYKYSHRVDKKPNRKLINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPQIIKTIASKTQSIKKYSTDILGNLYEVKSKKHP

SEQ ID NO: 96 - protein, 396 aa, Artificial Sequence
  Description of Artificial Sequence: Synthetic polypeptide
ATRGLMNLLRSYFRVNNLDVKVKSINGGFTSFLRRKWKFKKERNKGYKHHAEDALIVANADFIFKEWKKLDKAKKVMENQMFEEKQAESMPEIETEQEYKEIFITPHQIKHIKDFKDYKYSHRVDKKPNRELINDTLYSTRKDDKGNTLIVINLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPQIIKTIASKTQSIKKYSTDILGNLYEVKSKKHP

SEQ ID NO: 97 - protein, 396 aa, Artificial Sequence
  Description of Artificial Sequence: Synthetic polypeptide
ATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRKLINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPQIIKTIASKTQSIKKYSTDILGNLYEVKSKKHP

SEQ ID NO: 98 - protein, 402 aa, Artificial Sequence
  Description of Artificial Sequence: Synthetic polypeptide
ATRGLMNLLRSYFRVNNLDVKVKSINGGFTSFLRRKWKFKKERNKGYKHHAEDALIIANADFIFKEWKKLDKAKKVMENQMFEEKQAMSMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPDSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPHIIKTIASKTQSIKKYSTDILGNLYEVKSQKHPQIIKKG

SEQ ID NO: 99 - protein, 402 aa, Artificial Sequence
  Description of Artificial Sequence: Synthetic polypeptide
ATRGLMNLLRSYFRVNNLDVKVKSINGGFTSFLRRKWKFKKERNKGYKHHAEDALIIANADFIFKEWKKLDKAKKVMENQMFEEKQAGSMPEIETEQEYKEIFITPHQIKHIKDFKDYKYSHRVDKKPNRKLINDTLYSTRKDDKGNTLIVNNLNRLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLESMNDKRPPQIIKTIASKTQTIKKYSTDILGNLYEVKSKKHPQIIKKG

SEQ ID NO: 100 - protein, 402 aa, Artificial Sequence
  Description of Artificial Sequence: Synthetic polypeptide
ATRGLMNLLRSYYRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLTNKSPGKLLMYHHDPQTYQKLKLIMEQYGDEKNPLYKYYEETGNYLTKYSKKDNGPVIKKIKYYGNKLNAYLDITDDYPNSRNNVVKLSLKPYRFDVYLDNGVYKFVTVKNLDVIEKENYYEVNSKCYEEAKKLKKISNQAEFIASFYNNDLIKINGELYRVIGVNNDLLNRIEVNMIDITYREYLENMNDKRPPHIIKTIASKTQSIKKYSTDILGNLYEVKSKKHPQIIKKG

SEQ ID NO: 101 - protein, 402 aa, Artificial Sequence
  Description of Artificial Sequence: Synthetic polypeptide
ATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRKLINDTLYSTRKDDKGNTLIVNNLNGLYDKDNDKFKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKDNYYEVNSKCYEEAKKLKKISNQAEFIASFYNNDLIKINGELYRVIGVNNDLLNRIEVNMIDITYREYLENMNDKRPPQIIKTIATKTQSIKKYSTDILGNLYEVKSKKHPQIIKKG

SEQ ID NO: 102 - protein, 400 aa, Artificial Sequence
  Description of Artificial Sequence: Synthetic polypeptide
ATRGLMNLLRTYFRVNNLDVKVKSINGGFTSFLRRKWKFKKERNKGYKHHAEDALIIANADFIFKEWKKLDKAKKVMENQMFEEKHAESMPEIETEQEYKEIFITPHQIKHIKDFKDYKYSHRVDKKPNRELINDTLYSTRKDDKGNTLIVNNLNGLYDKDNDKLKKLIDKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPQIIKTIASKTQSIKKYSTDILGNLYEVKSKKHPQIIK

SEQ ID NO: 103 - protein, 402 aa, Artificial Sequence
  Description of Artificial Sequence: Synthetic polypeptide
ATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYNEIFITPHQIKHIKDFKDYKYSHRVDKKPNRKLINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLYVIKKENYYEVNSKCYEEAKKLKKISNQAEFIASFYNNDLIKINGELYRVIGVNNDLLNRIEVNMIDITYREYLENMNDKRPPQIIKTIASKTQSIKKYSTDILGNLYEVKSKKHPQIIKKG

SEQ ID NO: 104 - protein, 402 aa, Artificial Sequence
  Description of Artificial Sequence: Synthetic polypeptide
ATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRKLINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPQIIKTIASKTQSIKKYSTDILGNLYEVKSKKHPQIIKKG

SEQ ID NO: 105 - DNA, 20 bp, Artificial Sequence
  Description of Artificial Sequence: Synthetic oligonucleotide
gggcacgggcagcttgcccg

SEQ ID NO: 106 - DNA, 20 bp, Artificial Sequence
  Description of Artificial Sequence: Synthetic oligonucleotide
gtcgccctcgaacttcacct

SEQ ID NO: 107 - DNA, 70 bp, Artificial Sequence
  Description of Artificial Sequence: Synthetic oligonucleotide
cgtaaggagcgcgaggcggcggccgcggcggcggaggctgcaggactgagcgagcagatcgtgtttgagg

SEQ ID NO: 108 - DNA, 29 bp, Artificial Sequence
  Description of Artificial Sequence: Synthetic oligonucleotide
cgtaaggagcgagcagatcgtgtttgagg

SEQ ID NO: 109 - DNA, 36 bp, Artificial Sequence
  Description of Artificial Sequence: Synthetic oligonucleotide
cgtaaggagcgcgaggcgagcagatcgtgtttgagg

SEQ ID NO: 110 - DNA, 41 bp, Artificial Sequence
  Description of Artificial Sequence: Synthetic oligonucleotide
cgtaaggagcgcgaggctgagcgagcagatcgtgtttgagg

SEQ ID NO: 111 - DNA, 42 bp, Artificial Sequence
  Description of Artificial Sequence: Synthetic oligonucleotide
cgtaaggagcgcgaggcggcggcgagcagatcgtgtttgagg

SEQ ID NO: 112 - DNA, 54 bp, Artificial Sequence
  Description of Artificial Sequence: Synthetic oligonucleotide
cgtaaggagcgcgaggcggcggccgcagatcgagcgagcagatcgtgtttgagg

SEQ ID NO: 113 - DNA, 55 bp, Artificial Sequence
  Description of Artificial Sequence: Synthetic oligonucleotide
cgtaaggagcgcgaggcggcggccgcggcggctagcgagcagatcgtgtttgagg

SEQ ID NO: 114 - DNA, 55 bp, Artificial Sequence
  Description of Artificial Sequence: Synthetic oligonucleotide
cgtaaggagcgcgaggcggcggccgcggcggcgggcgagcagatcgtgtttgagg

SEQ ID NO: 115 - DNA, 56 bp, Artificial Sequence
  Description of Artificial Sequence: Synthetic oligonucleotide
cgtaaggagcgcgaggcggcggccgcggcggctgagcgagcagatcgtgtttgagg

SEQ ID NO: 116 - DNA, 51 bp, Artificial Sequence
  Description of Artificial Sequence: Synthetic oligonucleotide
cgtaaggagcgcgaggcagcggccgcggcggcgagcagatcgtgtttgagg

SEQ ID NO: 117 - DNA, 57 bp, Artificial Sequence
  Description of Artificial Sequence: Synthetic oligonucleotide
cgtaaggagcgcagagagcgtaaggagcgcgaggcggcgagcagatcgtgtttgagg

SEQ ID NO: 118 - DNA, 62 bp, Artificial Sequence
  Description of Artificial Sequence: Synthetic oligonucleotide
cgtaaggagcgcgaggcggcggccgcggcggcggaggctgagcgagcagatcgtgtttgagg

SEQ ID NO: 119 - DNA, 69 bp, Artificial Sequence
  Description of Artificial Sequence: Synthetic oligonucleotide
cgtaaggagcgcgaggcggcggccgcggcggcggaggctgcagactgagcgagcagatcgtgtttgagg

SEQ ID NO: 120 - DNA, 70 bp, Artificial Sequence
  Description of Artificial Sequence: Synthetic oligonucleotide
cgtaaggagcgcgaggcggcggccgcggcggcggaggctgagcgagactgagcgagcagatcgtgtttga

SEQ ID NO: 121 - DNA, 70 bp, Artificial Sequence
  Description of Artificial Sequence: Synthetic oligonucleotide
cgtaaggagcgcgaggcggcggccgcggcggcggaggctgcagcgagcagagcgagcagatcgtgtttga

SEQ ID NO: 122 - DNA, 61 bp, Artificial Sequence
  Description of Artificial Sequence: Synthetic oligonucleotide
tgtcgggaacctctccagggatgttacggaggccctcatcctgcaagtgttctctcagatc

SEQ ID NO: 123 - DNA, 49 bp, Artificial Sequence
  Description of Artificial Sequence: Synthetic oligonucleotide
tgtcgggtatgttacggaggccctcatcctgcaagtgttctctcagatc

SEQ ID NO: 124 - DNA, 53 bp, Artificial Sequence
  Description of Artificial Sequence: Synthetic oligonucleotide
tgtcgggaacctctgttacggaggccctcatcctgcaagtgttctctcagatc

SEQ ID NO: 125 - DNA, 56 bp, Artificial Sequence
  Description of Artificial Sequence: Synthetic oligonucleotide
tgtcgggaacctctcctgttacggaggccctcatcctgcaagtgttctctcagatc

SEQ ID NO: 126 - DNA, 57 bp, Artificial Sequence
  Description of Artificial Sequence: Synthetic oligonucleotide
tgtcgggaacctctccatgttacggaggccctcatcctgcaagtgttctctcagatc

SEQ ID NO: 127 - DNA, 60 bp, Artificial Sequence
  Description of Artificial Sequence: Synthetic oligonucleotide
tgtcgggaacctctccgggatgttacggaggcccttatcctgcaagtgttctctcagatc

SEQ ID NO: 128 - DNA, 60 bp, Artificial Sequence
  Description of Artificial Sequence: Synthetic oligonucleotide
tgtcgggaacctctccatgatgttacggaggccctcatcctgcaagtgttctctcagatc

SEQ ID NO: 129 - DNA, 61 bp, Artificial Sequence
  Description of Artificial Sequence: Synthetic oligonucleotide
tgtcgggaacctctccagggacgttacggaggccctcatcctgcaagtgttctctcagatc

SEQ ID NO: 130 - DNA, 61 bp, Artificial Sequence
  Description of Artificial Sequence: Synthetic oligonucleotide
tgtcgggaacctctgaaccggatgttacggaggccctcatcctgcaagtgttctctcagat

SEQ ID NO: 131 - DNA, 61 bp, Artificial Sequence
  Description of Artificial Sequence: Synthetic oligonucleotide
tgtcgggaacctctcgttacggagatgttacggaggccctcatcctgcaagtgttctctca

SEQ ID NO: 132 - DNA, 61 bp, Artificial Sequence
  Description of Artificial Sequence: Synthetic oligonucleotide
tgtcgggaacctctccatgttacggatgttacggaggccctcatcctgcaagtgttctctc

SEQ ID NO: 133 - DNA, 61 bp, Artificial Sequence
  Description of Artificial Sequence: Synthetic oligonucleotide
tgtcgggaacctctccatgttgtggatgttacggaggccctcatcctgcaagtgttctctc

SEQ ID NO: 134 - DNA, 61 bp, Artificial Sequence
  Description of Artificial Sequence: Synthetic oligonucleotide
tgtcgggaacctctccatttgagagggaattatttataaaataaataattacggaggccct

SEQ ID NO: 135 - DNA, 61 bp, Artificial Sequence
  Description of Artificial Sequence: Synthetic oligonucleotide
catggcgaccgggggcggaactactgctctccaaccagaggcgagaatcggggggcggacg

SEQ ID NO: 136 - DNA, 55 bp, Artificial Sequence
  Description of Artificial Sequence: Synthetic oligonucleotide
catggcgaccgggggcggaactactgcaccagaggcgagaatcggggggcggacg

SEQ ID NO: 137 - DNA, 56 bp, Artificial Sequence
  Description of Artificial Sequence: Synthetic oligonucleotide
catggcgaccgggggcggaactactgctctcagaggcgagaatcggggggcggacg

SEQ ID NO: 138 - DNA, 57 bp, Artificial Sequence
  Description of Artificial Sequence: Synthetic oligonucleotide
catggcgaccgggggcggaactactgctctccagaggcgagaatcggggggcggacg

SEQ ID NO: 139 - DNA, 57 bp, Artificial Sequence
  Description of Artificial Sequence: Synthetic oligonucleotide
catggcgaccgggggcggaactactgctcgccagaggcgagaatcggggggcggacg

SEQ ID NO: 140 - DNA, 61 bp, Artificial Sequence
  Description of Artificial Sequence: Synthetic oligonucleotide
catggcgaccgggggcggaactactgctctccagaggccagaggcgagaatcggggggcgg

SEQ ID NO: 141 - DNA, 61 bp, Artificial Sequence
  Description of Artificial Sequence: Synthetic oligonucleotide
catggcgaccgggggcggagctactgctctctactgctctctcaccagaggcgagaatcgg

SEQ ID NO: 142 - DNA, 24 bp, Artificial Sequence
  Description of Artificial Sequence: Synthetic oligonucleotide
  modified_base (21)..(21): a, c, t, g, unknown or other
  modified_base (24)..(24): a, c, t, g, unknown or other
gccacgaagcaggccaatggngan

SEQ ID NO: 143 - DNA, 24 bp, Artificial Sequence
  Description of Artificial Sequence: Synthetic oligonucleotide
  modified_base (21)..(21): a, c, t, g, unknown or other
  modified_base (24)..(24): a, c, t, g, unknown or other
gaatcccttctgcagcacctngan

SEQ ID NO: 144 - DNA, 24 bp, Artificial Sequence
  Description of Artificial Sequence: Synthetic oligonucleotide
  modified_base (21)..(21): a, c, t, g, unknown or other
  modified_base (24)..(24): a, c, t, g, unknown or other
gcggcggctgcacaaccagtngan

SEQ ID NO: 145 - DNA, 24 bp, Artificial Sequence
  Description of Artificial Sequence: Synthetic oligonucleotide
  modified_base (21)..(21): a, c, t, g, unknown or other
  modified_base (24)..(24): a, c, t, g, unknown or other
ggttgtgcagccgccgctccngan

SEQ ID NO: 146 - DNA, 24 bp, Artificial Sequence
  Description of Artificial Sequence: Synthetic oligonucleotide
  modified_base (21)..(21): a, c, t, g, unknown or other
  modified_base (24)..(24): a, c, t, g, unknown or other
ggtgcattttcaggaggaagngan

SEQ ID NO: 147 - DNA, 24 bp, Artificial Sequence
  Description of Artificial Sequence: Synthetic oligonucleotide
  modified_base (21)..(21): a, c, t, g, unknown or other
  modified_base (24)..(24): a, c, t, g, unknown or other
gagatgtagggctagaggggngan

SEQ ID NO: 148 - DNA, 24 bp, Artificial Sequence
  Description of Artificial Sequence: Synthetic oligonucleotide
  modified_base (21)..(21): a, c, t, g, unknown or other
  modified_base (24)..(24): a, c, t, g, unknown or other
gcgagcagcgtcttcgagagngan

SEQ ID NO: 149 - DNA, 24 bp, Artificial Sequence
  Description of Artificial Sequence: Synthetic oligonucleotide
  modified_base (21)..(21): a, c, t, g, unknown or other
  modified_base (24)..(24): a, c, t, g, unknown or other
gtgcggcaagagcttcagccngan

SEQ ID NO: 150 - DNA, 24 bp, Artificial Sequence
  Description of Artificial Sequence: Synthetic oligonucleotide
  modified_base (21)..(21): a, c, t, g, unknown or other
gcagaagggattccatgaggngcg

SEQ ID NO: 151 - DNA, 23 bp, Artificial Sequence
  Description of Artificial Sequence: Synthetic oligonucleotide
  modified_base (20)..(20): a, c, t, g, unknown or other
gaagggattccatgaggtgngcg

SEQ ID NO: 152 - DNA, 23 bp, Artificial Sequence
  Description of Artificial Sequence: Synthetic oligonucleotide
  modified_base (20)..(20): a, c, t, g, unknown or other
gggtgcattttcaggaggangcg

SEQ ID NO: 153 - DNA, 24 bp, Artificial Sequence
  Description of Artificial Sequence: Synthetic oligonucleotide
  modified_base (21)..(21): a, c, t, g, unknown or other
gcagacggcagtcactagggngcg

SEQ ID NO: 154 - DNA, 24 bp, Artificial Sequence
  Description of Artificial Sequence: Synthetic oligonucleotide
  modified_base (21)..(21): a, c, t, g, unknown or other
gctgggtgaatggagcgagcngcg

SEQ ID NO: 155 - DNA, 23 bp, Artificial Sequence
  Description of Artificial Sequence: Synthetic oligonucleotide
gagtccgagcagaagaagaaggg

SEQ ID NO: 156 - DNA, 23 bp, Artificial Sequence
  Description of Artificial Sequence: Synthetic oligonucleotide
gtgcggcaagagcttcagccggg

SEQ ID NO: 157 - DNA, 23 bp, Artificial Sequence
  Description of Artificial Sequence: Synthetic oligonucleotide
ggtgagtgagtgtgtgcgtgtgg

SEQ ID NO: 158 - DNA, 27 bp, Artificial Sequence
  Description of Artificial Sequence: Synthetic oligonucleotide
  modified_base (22)..(23): a, c, t, g, unknown or other
gcaaccacaaacccacgagggnngrrt

SEQ ID NO: 159 - DNA, 27 bp, Artificial Sequence
  Description of Artificial Sequence: Synthetic oligonucleotide
  modified_base (22)..(23): a, c, t, g, unknown or other
gggtgagtgagtgtgtgcgtgnngrrt

SEQ ID NO: 160 - DNA, 28 bp, Artificial Sequence
  Description of Artificial Sequence: Synthetic oligonucleotide
  modified_base (23)..(25): a, c, t, g, unknown or other
gtgtggttccagaaccggaggannnrrt

SEQ ID NO: 161 - DNA, 27 bp, Artificial Sequence
  Description of Artificial Sequence: Synthetic oligonucleotide
  modified_base (22)..(24): a, c, t, g, unknown or other
gctcagcctgagtgttgaggcnnnrrt

SEQ ID NO: 162 - DNA, 27 bp, Artificial Sequence
  Description of Artificial Sequence: Synthetic oligonucleotide
  modified_base (22)..(24): a, c, t, g, unknown or other
ggctctccgaggagaaggccannnrrt

SEQ ID NO: 163 - DNA, 28 bp, Artificial Sequence
  Description of Artificial Sequence: Synthetic oligonucleotide
  modified_base (23)..(25): a, c, t, g, unknown or other
gcgcccactgcaaggcccggcgnnnrrt

SEQ ID NO: 164 - DNA, 27 bp, Artificial Sequence
  Description of Artificial Sequence: Synthetic oligonucleotide
  modified_base (22)..(24): a, c, t, g, unknown or other
ggggtcccaggtgctgacgtannnrrt

SEQ ID NO: 165 - protein, 483 aa, Streptococcus pyogenes
LLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 166 - protein, 460 aa, Streptococcus mutans
LLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLNKLGGD

SEQ ID NO: 167 - protein, 496 aa, Streptococcus thermophilus
LLKSKLISQRKFDNLTKAERGGLLPEDKAGFIQRQLVETRQITKHVARLLDEKFNNKKDENNRAVRTVKIITLKSTLVSQFRKDFELYKVREINDFHHAHDAYLNAVIASALLKKYPKLEPEFVYGDYPKYNSFRERKSATEKVYFYSNIMNIFKKSISLADGRVIERPLIEVNEETGESVWNKESDLATVRRVLSYPQVNVVKKVEEQNHGLDRGKPKGLFNANLSSKPKPNSNENLVGAKEYLDPKKYGGYAGISNSFAVLVKGTIEKGAKKKITNVLEFQGISILDRINYRKDKLNFLLEKGYKDIELIIELPKYSLFELSDGSRRMLASILSTNNKRGEIHKGNQIFLSQKFVKLLYHAKRISNTINENHRKYVENHKKEFEELFYYILEFNENYVGAKKNGKLLNSAFQSWQNHSIDELCSSFIGPTGSERKGLFELTSRGSAADFEFLGVKIPRYRDYTPSSLLKDATLIHQSVTGLYETRIDLAKLGEG

SEQ ID NO: 168 - protein, 446 aa, Listeria innocua
LYQGNLMSKRKFDYLTKAERGGLTEADKARFIHRQLVETRQITKNVANILHQRFNYEKDDHGNTMKQVRIVTLKSALVSQFRKQFQLYKVRDVNDYHHAHDAYLNGVVANTLLKVYPQLEPEFVYGDYHQFDWFKANKATAKKQFYTNIMLFFAQKDRIIDENGEILWDKKYLDTVKKVMSYRQMNIVKKTEIQKGEFSKATIKPKGNSSKLIPRKTNWDPMKYGGLDSPNMAYAVVIEYAKGKNKLVFEKKIIRVTIMERKAFEKDEKAFLEEQGYRQPKVLAKLPKYTLYECEEGRRRMLASANEAQKGNQQVLPNHLVTLLHHAANCEVSDGKSLDYIESNREMFAELLAHVSEFAKRYTLAEANLNKINQLFEQNKEGDIKAIAQSFVDLMAFNAMGAPASFKFFETTIERKRYNNLKELLNSTIIYQSITGLYESRKRLDD

SEQ ID NO: 169 - protein, 470 aa, Trepanoma denticola
LAENHLISKRKLNNLTTDPDKIGKFTAQGFIHRQLVETSQVIRLVANILGNEYGHDGTTIIEVTAKMNHQMRKDFDLIKIRDVNDYHHAMDAYLTAYVGDYLYLRYPKLRSYFVYGDFKKLKDQSLKIRNFNFLHDLTNDEAGDKIVDQETGEIIWDKHESVKQLKKVYHYKFMLVSQEVYTRQDALFNQTIYPASDADKRKLIPIKNNKPVDVYGGYSGNVDAYMAIVRIHGKKEDKYKVVGVPMRAVADLKKAESKGRDNYLNAVHEVLKPQFTKKKKDRKTGEITEMMDDFDVLLGKVYYRQLIVDGNKKFMLGSSTYQYNAKQLVLSDKAMQVLSKDDKLKNQDENQNLIDVYDEILEKVDQYFELYDINKFRQKLHDGRKKFIELPVDNDFNGKKLISYGKRATIISILNGLHANATMSNLKYLGISSPFGMLQVPNGIILSPASRICYQSPTGLFERKVKLSDL

SEQ ID NO: 170 - protein, 470 aa, Lactobacillus buchneri
LQRNNFISLEKLNRLTRATPISDDETAKFIARQLVETRQATKVAAKVLEKMFPETKIVYSKAETVSMFRNKFDIVKCREINDFHHAHDAYLNIVVGNVYNTKFTNNPWNFIKEKRDNPKIADTYNYYKVFDYDVKRNNITAWEKGKTIITVKDMLKRNTPIYTRQAACKKGELFNQTIMKKGLGQHPLKKEGPFSNISKYGGYNKVSAAYYTLIEYEEKGNKIRSLETIPLYLVKDIQKDQDVLKSYLTDLLGKKEFKILVPKIKINSLLKINGFPCHITGKTNDSFLLRPAVQFCCSNNEVLYFKKIIRFSEIRSQREKIGKTISPYEDLSFRSYIKENLWKKTKNDEIGEKEFYDLLQKKNLEIYDMLLTKHKDTIYKKRPNSATIDILVKGKEKFKSLIIENQFEVILEILKLFSATRNVSDLQHIGGSKYSGVAKIGNKISSLDNCILIYQSITGIFEKRIDLLKV

SEQ ID NO: 171 - protein, 430 aa, Pasteurella multocida
FVALVLGSQCSAAKKQRLLTQVIDDNKFIDRNLNDTRYIARFLSNYIQENLLLVGKNKKNVFTPNGQITALLRSRWGLIKARENNNRHHALDAIVVACATPSMQQKITRFIRFKEVHPYKIENRYEMVDQESGEIISPHFPEPWAYFRQEVNIRVFDNHPDTVLKEMLPDRPQANHQFVQPLFVSRAPTRKMSGQGHMETIKSAKRLAEGISVLRIPLTQLKPNLLENMVNKEREPALYAGLKARLAEFNQDPAKAFATPFYKQGGQQVKAIRVEQVQKSGVLVRENNGVADNASIVRTDVFIKNNKFFLVPIYTWQVAKGILPNKAIVAHKNEDEWEEMDEGAKFKFSLFPNDLVELKTKKEYFFGYYIGLDRATGNISLKEHDGEISKGKDGVYRVGVKLALSFEKYQVDELGKNRQICRPQQRQPVR

SEQ ID NO: 172 - protein, 448 aa, Neisseria meningitidis
FKARVETSRFPRSKKQRILLQKFDEDGFKERNLNDTRYVNRFLCQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTPEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGDKYYLVPIYSWQVAKGILPDRAVVQGKDEEDWQLIDDSFNFKFSLHPNDLVEVITKKARMFGYFASCHRGTGNINIRIHDLDHKIGKNGILEGIGVKTALSFQKYQIDELGKEIRPCRLKKRPPVR

SEQ ID NO: 173 - protein, 381 aa, Campylobacter jejuni
IEVLAKNLPTKKQKRILDKNYKDKEQKNFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 174 - protein, 485 aa, Streptococcus gallolyticus
  Streptococcus gallolyticus pasteurianus
MKDYVLKQKGLGKKKRDYLLTTENIDKIEVKKKFIERNLVDTRYASRVVLNSLQSALRELGKDTKVSVVRGQFTSQLRRKWKIDKSRETYHHHAVDALIIAASSQLKLWEKQDNPMFVDYGKNQVVDKQTGEILSVSDDEYKELVFQPPYQGFVNTISSKGFEDEILFSYQVDSKYNRKVSDATIYSTRKAKIGKDKKEETYVLGKIKDIYSQNGFDTFIKKYNKDKTQFLMYQKDSLTWENVIEVILRDYPTTKKSEDGKNDVKCNPFEEYRRENGLICKYSKKGKGTPIKSLKYYDKKLGNCIDITPEESRNKVILQSINPWRADVYFNPETLKYELMGLKYSDLSFEKGTGNYHISQEKYDAIKEKEGIGKKSEFKFTLYRNDLILIKDIASGEQEIYRFLSRTMPNVNHYVELKPYDKEKFDNVQELVEALGEADKVGRCIKGLNKPNISIYKVRTDVLGNKYFVKKKGDKPKLDFKNNKK

SEQ ID NO: 175 - protein, 476 aa, Streptococcus thermophilus
LKAFVRESKTLSNKKKEYLLTEEDISKFDVRKKFIERNLVDTRYASRVVLNALQEHFRAHKIDTKVSVVRGQFTSQLRRHWGIEKTRDTYHHHAVDALIIAASSQLNLWKKQKNTLVSYSEDQLLDIETGELISDDEYKESVFKAPYQHFVDTLKSKEFEDSILFSYQVDSKFNRKISDATIYATRQAKVGKDKADETYVLGKIKDIYTQDGYDAFMKIYKKDKSKFLMYRHDPQTFEKVIEPILENYPNKQINEKGKEVPCNPFLKYKEEHGYIRKYSKKGNGPEIKSLKYYDSKLGNHIDITPKDSNNKVVLQSVSPWRADVYFNKTTGKYEILGLKYADLQFEKGTGTYKISQEKYNDIKKKEGVDSDSEFKFTLYKNDLLLVKDTETKEQQLFRFLSRTMPKQKHYVELKPYDKQKFEGGEALIKVLGNVANSGQCKKGLGKSNISIYKVRTDVLGNQHIIKNEGDKPKLDF

SEQ ID NO: 176 - protein, 450 aa, Staphylococcus aureus
FKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKHPQIIKKG

SEQ ID NO: 177-187 - skipped (11 entries)

SEQ ID NO: 188 - protein, 4 aa, Artificial Sequence
  Description of Artificial Sequence: Synthetic peptide
GGGS

SEQ ID NO: 189 - protein, 5 aa, Artificial Sequence
  Description of Artificial Sequence: Synthetic peptide
GGGGS

SEQ ID NO: 190 - DNA, 33 bp, Artificial Sequence
  Description of Artificial Sequence: Synthetic oligonucleotide
ctagagggcacgggcagcttgccggtgggcatg

SEQ ID NO: 191 - DNA, 25 bp, Artificial Sequence
  Description of Artificial Sequence: Synthetic oligonucleotide
cccaccggcaagctgcccgtgccct

SEQ ID NO: 192 - DNA, 34 bp, Artificial Sequence
  Description of Artificial Sequence: Synthetic oligonucleotide
ctagaggtcgccctcgaacttcacctcgggcatg

SEQ ID NO: 193 - DNA, 26 bp, Artificial Sequence
  Description of Artificial Sequence: Synthetic oligonucleotide
cccgaggtgaagttcgagggcgacct

SEQ ID NO: 194 - DNA, 33 bp, Artificial Sequence
  Description of Artificial Sequence: Synthetic oligonucleotide
aattcgggcacgggcagcttgccggtgggcatg

SEQ ID NO: 195 - DNA, 25 bp, Artificial Sequence
  Description of Artificial Sequence: Synthetic oligonucleotide
cccaccggcaagctgcccgtgcccg

SEQ ID NO: 196 - DNA, 34 bp, Artificial Sequence
  Description of Artificial Sequence: Synthetic oligonucleotide
aattcggtcgccctcgaacttcacctcgggcatg

SEQ ID NO: 197 - DNA, 26 bp, Artificial Sequence
  Description of Artificial Sequence: Synthetic oligonucleotide
cccgaggtgaagttcgagggcgaccg

SEQ ID NO: 198 - DNA, 60 bp, Artificial Sequence
  Description of Artificial Sequence: Synthetic oligonucleotide
  modified_base (31)..(36): a, c, t, g, unknown or other
  modified_base (39)..(41): a, c, t, g, unknown or other
gcaggaattcgggcacgggcagcttgccggnnnnnnctnnngcgcaggtcacgaggcatg

SEQ ID NO: 199 - DNA, 60 bp, Artificial Sequence
  Description of Artificial Sequence: Synthetic oligonucleotide
  modified_base (31)..(36): a, c, t, g, unknown or other
  modified_base (39)..(41): a, c, t, g, unknown or other
gcaggaattcgtcgccctcgaacttcacctnnnnnnctnnngcgcaggtcacgaggcatg

SEQ ID NO: 200 - DNA, 15 bp, Artificial Sequence
  Description of Artificial Sequence: Synthetic primer
cctcgtgacctgcgc

SEQ ID NO: 201 - DNA, 18 bp, Artificial Sequence
  Description of Artificial Sequence: Synthetic primer
gataccgctcgccgcagc

SEQ ID NO: 202 - DNA, 28 bp, Artificial Sequence
  Description of Artificial Sequence: Synthetic primer
ctgcgttctgatttaatctgtatcaggc

SEQ ID NO: 203 - DNA, 25 bp, Artificial Sequence
  Description of Artificial Sequence: Synthetic primer
ggagatgtaaatcacctccatctga

SEQ ID NO: 204 - DNA, 25 bp, Artificial Sequence
  Description of Artificial Sequence: Synthetic primer
atgttagcctacctcgaaaaccttc

SEQ ID NO: 205 - DNA, 25 bp, Artificial Sequence
  Description of Artificial Sequence: Synthetic primer
cctgtgctctcctgtttttaggtat

SEQ ID NO: 206 - DNA, 25 bp, Artificial Sequence
  Description of Artificial Sequence: Synthetic primer
aacatggtaagaagcgtgagtgttt

SEQ ID NO: 207 - DNA, 25 bp, Artificial Sequence
  Description of Artificial Sequence: Synthetic primer
caggctgttgaaccgtagatttagt

SEQ ID NO: 208 - DNA, 25 bp, Artificial Sequence
  Description of Artificial Sequence: Synthetic primer
tccacatgttttgagtttgagagtc

SEQ ID NO: 209 - DNA, 20 bp, Artificial Sequence
  Description of Artificial Sequence: Synthetic primer
ggagcagctggtcagagggg

SEQ ID NO: 210 - DNA, 22 bp, Artificial Sequence
  Description of Artificial Sequence: Synthetic primer
ccatagggaagggggacactgg

SEQ ID NO: 211 - DNA, 20 bp, Artificial Sequence
  Description of Artificial Sequence: Synthetic primer
gggccgggaaagagttgctg

SEQ ID NO: 212 - DNA, 22 bp, Artificial Sequence
  Description of Artificial Sequence: Synthetic primer
gccctacatctgctctccctcc

SEQ ID NO: 213 - DNA, 25 bp, Artificial Sequence
  Description of Artificial Sequence: Synthetic primer
ccagcacaacttactcgcacttgac

SEQ ID NO: 214 - DNA, 22 bp, Artificial Sequence
  Description of Artificial Sequence: Synthetic primer
catcaccaacccacagccaagg

SEQ ID NO: 215 - DNA, 21 bp, Artificial Sequence
  Description of Artificial Sequence: Synthetic primer
gatgagggctccagatggcac

SEQ ID NO: 216 - DNA, 23 bp, Artificial Sequence
  Description of Artificial Sequence: Synthetic primer
gaggagggagcaggaaagtgagg

SEQ ID NO: 217 - DNA, 20 bp, Artificial Sequence
  Description of Artificial Sequence: Synthetic oligonucleotide
gggcacgggcagcttgccgg

SEQ ID NO: 218 - DNA, 24 bp, Artificial Sequence
  Description of Artificial Sequence: Synthetic oligonucleotide
gggcacgggcagcttgccggtggt

SEQ ID NO: 219 - DNA, 20 bp, Artificial Sequence
  Description of Artificial Sequence: Synthetic oligonucleotide
gtcgccctcgaacttcacct

SEQ ID NO: 220 - DNA, 24 bp, Artificial Sequence
  Description of Artificial Sequence: Synthetic oligonucleotide
gtcgccctcgaacttcacctcggc

SEQ ID NO: 221 - DNA, 20 bp, Artificial Sequence
  Description of Artificial Sequence: Synthetic oligonucleotide
ggtcgccaccatggtgagca

SEQ ID NO: 222 - DNA, 24 bp, Artificial Sequence
  Description of Artificial Sequence: Synthetic oligonucleotide
ggtcgccaccatggtgagcaaggg

SEQ ID NO: 223 - DNA, 20 bp, Artificial Sequence
  Description of Artificial Sequence: Synthetic oligonucleotide
ggtcagggtggtcacgaggg

SEQ ID NO: 224 - DNA, 24 bp, Artificial Sequence
  Description of Artificial Sequence: Synthetic oligonucleotide
ggtcagggtggtcacgagggtggg

SEQ ID NO: 225 - DNA, 20 bp, Artificial Sequence
  Description of Artificial Sequence: Synthetic oligonucleotide
ggtggtgcagatgaacttca

SEQ ID NO: 226 - DNA, 24 bp, Artificial Sequence
  Description of Artificial Sequence: Synthetic oligonucleotide
ggtggtgcagatgaacttcagggt

SEQ ID NO: 227 - DNA, 20 bp, Artificial Sequence
  Description of Artificial Sequence: Synthetic oligonucleotide
gggtggtgcccatcctggtc

SEQ ID NO: 228 - DNA, 24 bp, Artificial Sequence
  Description of Artificial Sequence: Synthetic oligonucleotide
gggtggtgcccatcctggtcgagc

SEQ ID NO: 229 - DNA, 20 bp, Artificial Sequence
  Description of Artificial Sequence: Synthetic oligonucleotide
gacgtaaacggccacaagtt

SEQ ID NO: 230 - DNA, 24 bp, Artificial Sequence
  Description of Artificial Sequence: Synthetic oligonucleotide
gacgtaaacggccacaagttcagc

SEQ ID NO: 231 - DNA, 20 bp, Artificial Sequence
  Description of Artificial Sequence: Synthetic oligonucleotide
gtgcagatgaacttcagggt

SEQ ID NO: 232 - DNA, 24 bp, Artificial Sequence
  Description of Artificial Sequence: Synthetic oligonucleotide
gtgcagatgaacttcagggtcagc

SEQ ID NO: 233 - DNA, 20 bp, Artificial Sequence
  Description of Artificial Sequence: Synthetic oligonucleotide
gggtggtcacgagggtgggc

SEQ ID NO: 234 - DNA, 24 bp, Artificial Sequence
  Description of Artificial Sequence: Synthetic oligonucleotide
gggtggtcacgagggtgggccagg

SEQ ID NO: 235 - DNA, 20 bp, Artificial Sequence
  Description of Artificial Sequence: Synthetic oligonucleotide
ggtcgagctggacggcgacg

SEQ ID NO: 236 - DNA, 24 bp, Artificial Sequence
  Description of Artificial Sequence: Synthetic oligonucleotide
ggtcgagctggacggcgacgtaaa

SEQ ID NO: 237 - DNA, 20 bp, Artificial Sequence
  Description of Artificial Sequence: Synthetic oligonucleotide
gtcgagctggacggcgacgt

SEQ ID NO: 238 - DNA, 24 bp, Artificial Sequence
  Description of Artificial Sequence: Synthetic oligonucleotide
gtcgagctggacggcgacgtaaac

SEQ ID NO: 239 - DNA, 20 bp, Artificial Sequence
  Description of Artificial Sequence: Synthetic oligonucleotide
ggggtggtgcccatcctggt

SEQ ID NO: 240 - DNA, 24 bp, Artificial Sequence
  Description of Artificial Sequence: Synthetic oligonucleotide
ggggtggtgcccatcctggtcgag

SEQ ID NO: 241 - DNA, 20 bp, Artificial Sequence
  Description of Artificial Sequence: Synthetic oligonucleotide
gccaccatggtgagcaaggg

SEQ ID NO: 242 - DNA, 24 bp, Artificial Sequence
  Description of Artificial Sequence: Synthetic oligonucleotide
gccaccatggtgagcaagggcgag

SEQ ID NO: 243 - DNA, 20 bp, Artificial Sequence
  Description of Artificial Sequence: Synthetic oligonucleotide
gtcgccgtccagctcgacca

SEQ ID NO: 244 - DNA, 24 bp, Artificial Sequence
  Description of Artificial Sequence: Synthetic oligonucleotide
gtcgccgtccagctcgaccaggat

SEQ ID NO: 245 - DNA, 20 bp, Artificial Sequence
  Description of Artificial Sequence: Synthetic oligonucleotide
gcatcgccctcgccctcgcc

SEQ ID NO: 246 - DNA, 24 bp, Artificial Sequence
  Description of Artificial Sequence: Synthetic oligonucleotide
gcatcgccctcgccctcgccggac

SEQ ID NO: 247 - DNA, 20 bp, Artificial Sequence
  Description of Artificial Sequence: Synthetic oligonucleotide
gttcgagggcgacaccctgg

SEQ ID NO: 248 - DNA, 24 bp, Artificial Sequence
  Description of Artificial Sequence: Synthetic oligonucleotide
gttcgagggcgacaccctggtgaa

SEQ ID NO: 249 - DNA, 20 bp, Artificial Sequence
  Description of Artificial Sequence: Synthetic oligonucleotide
gttcgagggcgacaccctgg

SEQ ID NO: 250 - DNA, 24 bp, Artificial Sequence
  Description of Artificial Sequence: Synthetic oligonucleotide
gttcgagggcgacaccctggtgaa

SEQ ID NO: 251 - DNA, 20 bp, Artificial Sequence
  Description of Artificial Sequence: Synthetic oligonucleotide
gttcaccagggtgtcgccct

SEQ ID NO: 252 - DNA, 24 bp, Artificial Sequence
  Description of Artificial Sequence: Synthetic oligonucleotide
gttcaccagggtgtcgccctcgaa

SEQ ID NO: 253 - DNA, 20 bp, Artificial Sequence
  Description of Artificial Sequence: Synthetic oligonucleotide
gcagaagaacggcatcaagg

SEQ ID NO: 254 - DNA, 24 bp, Artificial Sequence
  Description of Artificial Sequence: Synthetic oligonucleotide
gcagaagaacggcatcaaggtgaa

SEQ ID NO: 255 - DNA, 17 bp, Artificial Sequence
  Description of Artificial Sequence: Synthetic oligonucleotide
gaagaacggcatcaagg

SEQ ID NO: 256 - DNA, 21 bp, Artificial Sequence
  Description of Artificial Sequence: Synthetic oligonucleotide
gaagaacggcatcaaggtgaa

SEQ ID NO: 257 - DNA, 20 bp, Artificial Sequence
  Description of Artificial Sequence: Synthetic oligonucleotide
gcccaccctcgtgaccaccc

SEQ ID NO: 258 - DNA, 24 bp, Artificial Sequence
  Description of Artificial Sequence: Synthetic oligonucleotide
gcccaccctcgtgaccaccctgac

SEQ ID NO: 259 - DNA, 20 bp, Artificial Sequence
  Description of Artificial Sequence: Synthetic oligonucleotide
gcccttgctcaccatggtgg

SEQ ID NO: 260 - DNA, 24 bp, Artificial Sequence
  Description of Artificial Sequence: Synthetic oligonucleotide
gcccttgctcaccatggtggcgac

SEQ ID NO: 261 - DNA, 20 bp, Artificial Sequence
  Description of Artificial Sequence: Synthetic oligonucleotide
gtcgccgtccagctcgacca

SEQ ID NO: 262 - DNA, 24 bp, Artificial Sequence
  Description of Artificial Sequence: Synthetic oligonucleotide
gtcgccgtccagctcgaccaggat

SEQ ID NO: 263 - DNA, 17 bp, Artificial Sequence
  Description of Artificial Sequence: Synthetic oligonucleotide
gccgtccagctcgacca

SEQ ID NO: 264 - DNA, 21 bp, Artificial Sequence
  Description of Artificial Sequence: Synthetic oligonucleotide
gccgtccagctcgaccaggat

SEQ ID NO: 265 - DNA, 20 bp, Artificial Sequence
  Description of Artificial Sequence: Synthetic oligonucleotide
gtgtccggcgagggcgaggg

SEQ ID NO: 266 - DNA, 24 bp, Artificial Sequence
  Description of Artificial Sequence: Synthetic oligonucleotide
gtgtccggcgagggcgagggcgat

SEQ ID NO: 267 - DNA, 20 bp, Artificial Sequence
  Description of Artificial Sequence: Synthetic oligonucleotide
gggcagcttgccggtggtgc

SEQ ID NO: 268 - DNA, 24 bp, Artificial Sequence
  Description of Artificial Sequence: Synthetic oligonucleotide
gggcagcttgccggtggtgcagat

SEQ ID NO: 269 - DNA, 19 bp, Artificial Sequence
  Description of Artificial Sequence: Synthetic oligonucleotide
ggcagcttgccggtggtgc

SEQ ID NO: 270 - DNA, 23 bp, Artificial Sequence
  Description of Artificial Sequence: Synthetic oligonucleotide
ggcagcttgccggtggtgcagat

SEQ ID NO: 271 - DNA, 18 bp, Artificial Sequence
  Description of Artificial Sequence: Synthetic oligonucleotide
gcagcttgccggtggtgc

SEQ ID NO: 272 - DNA, 22 bp, Artificial Sequence
  Description of Artificial Sequence: Synthetic oligonucleotide
gcagcttgccggtggtgcagat

SEQ ID NO: 273 - DNA, 20 bp, Artificial Sequence
  Description of Artificial Sequence: Synthetic oligonucleotide
ggggtggtgcccatcctggt

SEQ ID NO: 274 - DNA, 24 bp, Artificial Sequence
  Description of Artificial Sequence: Synthetic oligonucleotide
ggggtggtgcccatcctggtcgag

SEQ ID NO: 275 - DNA, 19 bp, Artificial Sequence
  Description of Artificial Sequence: Synthetic oligonucleotide
gggtggtgcccatcctggt

SEQ ID NO: 276 - DNA, 23 bp, Artificial Sequence
  Description of Artificial Sequence: Synthetic oligonucleotide
gggtggtgcccatcctggtcgag

SEQ ID NO: 277 - DNA, 18 bp, Artificial Sequence
  Description of Artificial Sequence: Synthetic oligonucleotide
ggtggtgcccatcctggt

SEQ ID NO: 278 - DNA, 22 bp, Artificial Sequence
  Description of Artificial Sequence: Synthetic oligonucleotide
ggtggtgcccatcctggtcgag

SEQ ID NO: 279 - DNA, 17 bp, Artificial Sequence
  Description of Artificial Sequence: Synthetic oligonucleotide
gtggtgcccatcctggt

SEQ ID NO: 280 - DNA, 21 bp, Artificial Sequence
  Description of Artificial Sequence: Synthetic oligonucleotide
gtggtgcccatcctggtcgag

SEQ ID NO: 281 - DNA, 20 bp, Artificial Sequence
  Description of Artificial Sequence: Synthetic oligonucleotide
gccaccatggtgagcaaggg

SEQ ID NO: 282 - DNA, 24 bp, Artificial Sequence
  Description of Artificial Sequence: Synthetic oligonucleotide
gccaccatggtgagcaagggcgag

SEQ ID NO: 283 - DNA, 20 bp, Artificial Sequence
  Description of Artificial Sequence: Synthetic oligonucleotide
gccgtaggtcagggtggtca

SEQ ID NO: 284 - DNA, 24 bp, Artificial Sequence
  Description of Artificial Sequence: Synthetic oligonucleotide
gccgtaggtcagggtggtcacgag

SEQ ID NO: 285 - DNA, 17 bp, Artificial Sequence
  Description of Artificial Sequence: Synthetic oligonucleotide
gtaggtcagggtggtca

SEQ ID NO: 286 - DNA, 21 bp, Artificial Sequence
  Description of Artificial Sequence: Synthetic oligonucleotide
gtaggtcagggtggtcacgag

SEQ ID NO: 287 - DNA, 20 bp, Artificial Sequence
  Description of Artificial Sequence: Synthetic oligonucleotide
gctgcccgacaaccactacc

SEQ ID NO: 288 - DNA, 24 bp, Artificial Sequence
  Description of Artificial Sequence: Synthetic oligonucleotide
gctgcccgacaaccactacctgag

SEQ ID NO: 289 - DNA, 17 bp, Artificial Sequence
  Description of Artificial Sequence: Synthetic oligonucleotide
gcccgacaaccactacc

SEQ ID NO: 290 - DNA, 21 bp, Artificial Sequence
  Description of Artificial Sequence: Synthetic oligonucleotide
gcccgacaaccactacctgag

SEQ ID NO: 291 - DNA, 20 bp, Artificial Sequence
  Description of Artificial Sequence: Synthetic oligonucleotide
gcgagggcgatgccacctac

SEQ ID NO: 292 - DNA, 24 bp, Artificial Sequence
  Description of Artificial Sequence: Synthetic oligonucleotide
gcgagggcgatgccacctacggca

SEQ ID NO: 293 - DNA, 20 bp, Artificial Sequence
  Description of Artificial Sequence: Synthetic oligonucleotide
gtggtcggggtagcggctga

SEQ ID NO: 294 - DNA, 24 bp, Artificial Sequence
  Description of Artificial Sequence: Synthetic oligonucleotide
gtggtcggggtagcggctgaagca

SEQ ID NO: 295 - DNA, 20 bp, Artificial Sequence
  Description of Artificial Sequence: Synthetic oligonucleotide
ggagctgttcaccggggtgg

SEQ ID NO: 296 - DNA, 24 bp, Artificial Sequence
  Description of Artificial Sequence: Synthetic oligonucleotide
ggagctgttcaccggggtggtgcc

SEQ ID NO: 297 - DNA, 20 bp, Artificial Sequence
  Description of Artificial Sequence: Synthetic oligonucleotide
gaacttgtggccgtttacgt

SEQ ID NO: 298 - DNA, 24 bp, Artificial Sequence
  Description of Artificial Sequence: Synthetic oligonucleotide
gaacttgtggccgtttacgtcgcc

SEQ ID NO: 299 - DNA, 20 bp, Artificial Sequence
  Description of Artificial Sequence: Synthetic oligonucleotide
ggtgaacagctcctcgccct

SEQ ID NO: 300 - DNA, 24 bp, Artificial Sequence
  Description of Artificial Sequence: Synthetic oligonucleotide
ggtgaacagctcctcgcccttgct

SEQ ID NO: 301 - DNA, 20 bp, Artificial Sequence
  Description of Artificial Sequence: Synthetic oligonucleotide
ggtggtgcccatcctggtcg

SEQ ID NO: 302 - DNA, 24 bp, Artificial Sequence
  Description of Artificial Sequence: Synthetic oligonucleotide
ggtggtgcccatcctggtcgagct

SEQ ID NO: 303 - DNA, 20 bp, Artificial Sequence
  Description of Artificial Sequence: Synthetic oligonucleotide
gccacaagttcagcgtgtcc

SEQ ID NO: 304 - DNA, 24 bp, Artificial Sequence
  Description of Artificial Sequence: Synthetic oligonucleotide
gccacaagttcagcgtgtccggcg

SEQ ID NO: 305 - DNA, 20 bp, Artificial Sequence
  Description of Artificial Sequence: Synthetic oligonucleotide
gcgtgtccggcgagggcgag

SEQ ID NO: 306 - DNA, 24 bp, Artificial Sequence
  Description of Artificial Sequence: Synthetic oligonucleotide
gcgtgtccggcgagggcgagggcg

SEQ ID NO: 307 - DNA, 18 bp, Artificial Sequence
  Description of Artificial Sequence: Synthetic oligonucleotide
gtgtccggcgagggcgag

SEQ ID NO: 308 - DNA, 22 bp, Artificial Sequence
  Description of Artificial Sequence: Synthetic oligonucleotide
gtgtccggcgagggcgagggcg

SEQ ID NO: 309 - DNA, 20 bp, Artificial Sequence
  Description of Artificial Sequence: Synthetic oligonucleotide
gcccgaaggctacgtccagg

SEQ ID NO: 310 - DNA, 24 bp, Artificial Sequence
  Description of Artificial Sequence: Synthetic oligonucleotide
gcccgaaggctacgtccaggagcg

SEQ ID NO: 311 - DNA, 20 bp, Artificial Sequence
  Description of Artificial Sequence: Synthetic oligonucleotide
gtcgtccttgaagaagatgg

SEQ ID NO: 312 - DNA, 24 bp, Artificial Sequence
  Description of Artificial Sequence: Synthetic oligonucleotide
gtcgtccttgaagaagatggtgcg

SEQ ID NO: 313 - DNA, 17 bp, Artificial Sequence
  Description of Artificial Sequence: Synthetic oligonucleotide
gtccttgaagaagatgg

SEQ ID NO: 314 - DNA, 21 bp, Artificial Sequence
  Description of Artificial Sequence: Synthetic oligonucleotide
gtccttgaagaagatggtgcg

SEQ ID NO: 315 - DNA, 20 bp, Artificial Sequence
  Description of Artificial Sequence: Synthetic oligonucleotide
ggtcgccaccatggtgagca

SEQ ID NO: 316 - DNA, 24 bp, Artificial Sequence
  Description of Artificial Sequence: Synthetic oligonucleotide
ggtcgccaccatggtgagcaaggg

SEQ ID NO: 317 - DNA, 20 bp, Artificial Sequence
  Description of Artificial Sequence: Synthetic oligonucleotide
ggtggtcacgagggtgggcc

SEQ ID NO: 318 - DNA, 24 bp, Artificial Sequence
  Description of Artificial Sequence: Synthetic oligonucleotide
ggtggtcacgagggtgggccaggg

SEQ ID NO: 319 - DNA, 20 bp, Artificial Sequence
  Description of Artificial Sequence: Synthetic oligonucleotide
gatccaccggtcgccaccat

SEQ ID NO: 320 - DNA, 24 bp, Artificial Sequence
  Description of Artificial Sequence: Synthetic oligonucleotide
gatccaccggtcgccaccatggtg

SEQ ID NO: 321 - DNA, 20 bp, Artificial Sequence
  Description of Artificial Sequence: Synthetic oligonucleotide
gtaaacggccacaagttcag

SEQ ID NO: 322 - DNA, 24 bp, Artificial Sequence
  Description of Artificial Sequence: Synthetic oligonucleotide
gtaaacggccacaagttcagcgtg

SEQ ID NO: 323 - DNA, 20 bp, Artificial Sequence
  Description of Artificial Sequence: Synthetic oligonucleotide
gagtccgagcagaagaagaa

SEQ ID NO: 324 - DNA, 24 bp, Artificial Sequence
  Description of Artificial Sequence: Synthetic oligonucleotide
gagtccgagcagaagaagaagggc

SEQ ID NO: 325 - DNA, 20 bp, Artificial Sequence
  Description of Artificial Sequence: Synthetic oligonucleotide
gtcacctccaatgactaggg

SEQ ID NO: 326 - DNA, 24 bp, Artificial Sequence
  Description of Artificial Sequence: Synthetic oligonucleotide
gtcacctccaatgactagggtggg

SEQ ID NO: 327 - DNA, 20 bp, Artificial Sequence
  Description of Artificial Sequence: Synthetic oligonucleotide
gaggaggaagggcctgagtc

SEQ ID NO: 328 - DNA, 24 bp, Artificial Sequence
  Description of Artificial Sequence: Synthetic oligonucleotide
gaggaggaagggcctgagtccgag

SEQ ID NO: 329 - DNA, 20 bp, Artificial Sequence
  Description of Artificial Sequence: Synthetic oligonucleotide
ggttgcccaccctagtcatt

SEQ ID NO: 330 - DNA, 24 bp, Artificial Sequence
  Description of Artificial Sequence: Synthetic oligonucleotide
ggttgcccaccctagtcattggag

SEQ ID NO: 331 - DNA, 20 bp, Artificial Sequence
  Description of Artificial Sequence: Synthetic oligonucleotide
gctgagctgagagcctgatg

SEQ ID NO: 332 - DNA, 24 bp, Artificial Sequence
  Description of Artificial Sequence: Synthetic oligonucleotide
gctgagctgagagcctgatgggaa

SEQ ID NO: 333 - DNA, 20 bp, Artificial Sequence
  Description of Artificial Sequence: Synthetic oligonucleotide
gccacgaagcaggccaatgg

SEQ ID NO: 334 - DNA, 24 bp, Artificial Sequence
  Description of Artificial Sequence: Synthetic oligonucleotide
gccacgaagcaggccaatggggag

SEQ ID NO: 335 - DNA, 20 bp, Artificial Sequence
  Description of Artificial Sequence: Synthetic oligonucleotide
ggaatcccttctgcagcacc

SEQ ID NO: 336 - DNA, 24 bp, Artificial Sequence
  Description of Artificial Sequence: Synthetic oligonucleotide
ggaatcccttctgcagcacctgga

SEQ ID NO: 337 - DNA, 20 bp, Artificial Sequence
  Description of Artificial Sequence: Synthetic oligonucleotide
gctgcagaagggattccatg

SEQ ID NO: 338 - DNA, 24 bp, Artificial Sequence
  Description of Artificial Sequence: Synthetic oligonucleotide
gctgcagaagggattccatgaggt

SEQ ID NO: 339 - DNA, 20 bp, Artificial Sequence
  Description of Artificial Sequence: Synthetic oligonucleotide
gaatcccttctgcagcacct

SEQ ID NO: 340 - DNA, 24 bp, Artificial Sequence
  Description of Artificial Sequence: Synthetic oligonucleotide
gaatcccttctgcagcacctggat

SEQ ID NO: 341 - DNA, 20 bp, Artificial Sequence
  Description of Artificial Sequence: Synthetic oligonucleotide
gtgctgcagaagggattcca

SEQ ID NO: 342 - DNA, 24 bp, Artificial Sequence
  Description of Artificial Sequence: Synthetic oligonucleotide
gtgctgcagaagggattccatgag

SEQ ID NO: 343 - DNA, 20 bp, Artificial Sequence
  Description of Artificial Sequence: Synthetic oligonucleotide
gcggcggctgcacaaccagt

SEQ ID NO: 344 - DNA, 24 bp, Artificial Sequence
  Description of Artificial Sequence: Synthetic oligonucleotide
gcggcggctgcacaaccagtggag

SEQ ID NO: 345 - DNA, 20 bp, Artificial Sequence
  Description of Artificial Sequence: Synthetic oligonucleotide
ggttgtgcagccgccgctcc

SEQ ID NO: 346 - DNA, 24 bp, Artificial Sequence
  Description of Artificial Sequence: Synthetic oligonucleotide
ggttgtgcagccgccgctccagag

SEQ ID NO: 347 - DNA, 20 bp, Artificial Sequence
  Description of Artificial Sequence: Synthetic oligonucleotide
gaggcaagagggcggctttg

SEQ ID NO: 348 - DNA, 24 bp, Artificial Sequence
  Description of Artificial Sequence: Synthetic oligonucleotide
gaggcaagagggcggctttgggcg

SEQ ID NO: 349 - DNA, 19 bp, Artificial Sequence
  Description of Artificial Sequence: Synthetic oligonucleotide
ggggtccagttccgggatt

SEQ ID NO: 350 - DNA, 23 bp, Artificial Sequence
  Description of Artificial Sequence: Synthetic oligonucleotide
ggggtccagttccgggattagcg

SEQ ID NO: 351 - DNA, 20 bp, Artificial Sequence
  Description of Artificial Sequence: Synthetic oligonucleotide
gcagaagggattccatgagg

SEQ ID NO: 352 - DNA, 24 bp, Artificial Sequence
  Description of Artificial Sequence: Synthetic oligonucleotide
gcagaagggattccatgaggtgcg

SEQ ID NO: 353 - DNA, 19 bp, Artificial Sequence
  Description of Artificial Sequence: Synthetic oligonucleotide
gaagggattccatgaggtg

SEQ ID NO: 354 - DNA, 23 bp, Artificial Sequence
  Description of Artificial Sequence: Synthetic oligonucleotide
gaagggattccatgaggtgcgcg

SEQ ID NO: 355 - DNA, 20 bp, Artificial Sequence
  Description of Artificial Sequence: Synthetic oligonucleotide
gctgaaacagtgacctgtct

SEQ ID NO: 356 - DNA, 24 bp, Artificial Sequence
  Description of Artificial Sequence: Synthetic oligonucleotide
gctgaaacagtgacctgtcttggt

SEQ ID NO: 357 - DNA, 20 bp, Artificial Sequence
  Description of Artificial Sequence: Synthetic oligonucleotide
gatgtagggctagaggggtg

SEQ ID NO: 358 - DNA, 24 bp, Artificial Sequence
  Description of Artificial Sequence: Synthetic oligonucleotide
gatgtagggctagaggggtgaggc

SEQ ID NO: 359 - DNA, 20 bp, Artificial Sequence
  Description of Artificial Sequence: Synthetic oligonucleotide
ggtgcattttcaggaggaag

SEQ ID NO: 360 - DNA, 24 bp, Artificial Sequence
  Description of Artificial Sequence: Synthetic oligonucleotide
ggtgcattttcaggaggaagcgat

SEQ ID NO: 361 - DNA, 20 bp, Artificial Sequence
  Description of Artificial Sequence: Synthetic oligonucleotide
gttttcgctccgaaggtaaa

SEQ ID NO: 362 - DNA, 24 bp, Artificial Sequence
  Description of Artificial Sequence: Synthetic oligonucleotide
gttttcgctccgaaggtaaaagaa

SEQ ID NO: 363 - DNA, 20 bp, Artificial Sequence
  Description of Artificial Sequence: Synthetic oligonucleotide
gagatgtagggctagagggg

SEQ ID NO: 364 - DNA, 24 bp, Artificial Sequence
  Description of Artificial Sequence: Synthetic oligonucleotide
gagatgtagggctagaggggtgag

SEQ ID NO: 365 - DNA, 20 bp, Artificial Sequence
  Description of Artificial Sequence: Synthetic oligonucleotide
gcagaggggagaagaaagag

SEQ ID NO: 366 - DNA, 24 bp, Artificial Sequence
  Description of Artificial Sequence: Synthetic oligonucleotide
gcagaggggagaagaaagagagat

SEQ ID NO: 367 - DNA, 19 bp, Artificial Sequence
  Description of Artificial Sequence: Synthetic oligonucleotide
gggtgcattttcaggagga

SEQ ID NO: 368 - DNA, 23 bp, Artificial Sequence
  Description of Artificial Sequence: Synthetic oligonucleotide
gggtgcattttcaggaggaagcg

SEQ ID NO: 369 - DNA, 20 bp, Artificial Sequence
  Description of Artificial Sequence: Synthetic oligonucleotide
ggtgagtgagtgtgtgcgtg

SEQ ID NO: 370 - DNA, 24 bp, Artificial Sequence
  Description of Artificial Sequence: Synthetic oligonucleotide
ggtgagtgagtgtgtgcgtgtggg

SEQ ID NO: 371 - DNA, 20 bp, Artificial Sequence
  Description of Artificial Sequence: Synthetic oligonucleotide
gttggagcggggagaaggcc

SEQ ID NO: 372 - DNA, 24 bp, Artificial Sequence
  Description of Artificial Sequence: Synthetic oligonucleotide
gttggagcggggagaaggccaggg

SEQ ID NO: 373 - DNA, 20 bp, Artificial Sequence
  Description of Artificial Sequence: Synthetic oligonucleotide
gcgagcagcgtcttcgagag

SEQ ID NO: 374 - DNA, 24 bp, Artificial Sequence
  Description of Artificial Sequence: Synthetic oligonucleotide
gcgagcagcgtcttcgagagtgag

SEQ ID NO: 375 - DNA, 20 bp, Artificial Sequence
  Description of Artificial Sequence: Synthetic oligonucleotide
gacgtgtgtgtctgtgtggg

SEQ ID NO: 376 - DNA, 24 bp, Artificial Sequence
  Description of Artificial Sequence: Synthetic oligonucleotide
gacgtgtgtgtctgtgtgggtgag

SEQ ID NO: 377 - DNA, 20 bp, Artificial Sequence
  Description of Artificial Sequence: Synthetic oligonucleotide
ggttgagggcgttggagcgg

SEQ ID NO: 378 - DNA, 24 bp, Artificial Sequence
  Description of Artificial Sequence: Synthetic oligonucleotide
ggttgagggcgttggagcggggag

SEQ ID NO: 379 - DNA, 20 bp, Artificial Sequence
  Description of Artificial Sequence: Synthetic oligonucleotide
gctttggaaagggggtgggg

SEQ ID NO: 380 - DNA, 24 bp, Artificial Sequence
  Description of Artificial Sequence: Synthetic oligonucleotide
gctttggaaagggggtggggggag

SEQ ID NO: 381 - DNA, 20 bp, Artificial Sequence
  Description of Artificial Sequence: Synthetic oligonucleotide
gcagacggcagtcactaggg

SEQ ID NO: 382 - DNA, 24 bp, Artificial Sequence
  Description of Artificial Sequence: Synthetic oligonucleotide
gcagacggcagtcactagggggcg

SEQ ID NO: 383 - DNA, 20 bp, Artificial Sequence
  Description of Artificial Sequence: Synthetic oligonucleotide
gctgggtgaatggagcgagc

SEQ ID NO: 384 - DNA, 24 bp, Artificial Sequence
  Description of Artificial Sequence: Synthetic oligonucleotide
gctgggtgaatggagcgagcagcg

SEQ ID NO: 385 - DNA, 19 bp, Artificial Sequence
  Description of Artificial Sequence: Synthetic oligonucleotide
gtgtgggtgagtgagtgtg

SEQ ID NO: 386 - DNA, 23 bp, Artificial Sequence
  Description of Artificial Sequence: Synthetic oligonucleotide
gtgtgggtgagtgagtgtgtgcg

SEQ ID NO: 387 - DNA, 19 bp, Artificial Sequence
  Description of Artificial Sequence: Synthetic oligonucleotide
gtgtgcgtgtggggttgag

SEQ ID NO: 388 - DNA, 23 bp, Artificial Sequence
  Description of Artificial Sequence: Synthetic oligonucleotide
gtgtgcgtgtggggttgagggcg

SEQ ID NO: 389 - DNA, 20 bp, Artificial Sequence
  Description of Artificial Sequence: Synthetic oligonucleotide
gtcgtgctgcttcatgtggt

SEQ ID NO: 390 - DNA, 26 bp, Artificial Sequence
  Description of Artificial Sequence: Synthetic oligonucleotide
gtcgtgctgcttcatgtggtcggggt

SEQ ID NO: 391 - DNA, 23 bp, Artificial Sequence
  Description of Artificial Sequence: Synthetic oligonucleotide
gaagtcgtgctgcttcatgtggt

SEQ ID NO: 392 - DNA, 29 bp, Artificial Sequence
  Description of Artificial Sequence: Synthetic oligonucleotide
gaagtcgtgctgcttcatgtggtcggggt

SEQ ID NO: 393 - DNA, 21 bp, Artificial Sequence
  Description of Artificial Sequence: Synthetic oligonucleotide
gccggtggtgcagatgaactt

SEQ ID NO: 394 - DNA, 27 bp, Artificial Sequence
  Description of Artificial Sequence: Synthetic oligonucleotide
gccggtggtgcagatgaacttcagggt

SEQ ID NO: 395 - DNA, 21 bp, Artificial Sequence
  Description of Artificial Sequence: Synthetic oligonucleotide
gccgtaggtcagggtggtcac

SEQ ID NO: 396 - DNA, 27 bp, Artificial Sequence
  Description of Artificial Sequence: Synthetic oligonucleotide
gccgtaggtcagggtggtcacgagggt

SEQ ID NO: 397 - DNA, 21 bp, Artificial Sequence
  Description of Artificial Sequence: Synthetic oligonucleotide
gcaacatcctggggcacaagc

SEQ ID NO: 398 - DNA, 27 bp, Artificial Sequence
  Description of Artificial Sequence: Synthetic oligonucleotide
gcaacatcctggggcacaagctggagt

SEQ ID NO: 399 - DNA, 22 bp, Artificial Sequence
  Description of Artificial Sequence: Synthetic oligonucleotide
ggcaacatcctggggcacaagc

SEQ ID NO: 400 - DNA, 28 bp, Artificial Sequence
  Description of Artificial Sequence: Synthetic oligonucleotide
ggcaacatcctggggcacaagctggagt

SEQ ID NO: 401 - DNA, 21 bp, Artificial Sequence
  Description of Artificial Sequence: Synthetic oligonucleotide
gaagcactgcacgccgtaggt

SEQ ID NO: 402 - DNA, 27 bp, Artificial Sequence
  Description of Artificial Sequence: Synthetic oligonucleotide
gaagcactgcacgccgtaggtcagggt

SEQ ID NO: 403 - DNA, 24 bp, Artificial Sequence
  Description of Artificial Sequence: Synthetic oligonucleotide
gctgaagcactgcacgccgtaggt

SEQ ID NO: 404 - DNA, 30 bp, Artificial Sequence
  Description of Artificial Sequence: Synthetic oligonucleotide
gctgaagcactgcacgccgtaggtcagggt

SEQ ID NO: 405 - DNA, 21 bp, Artificial Sequence
  Description of Artificial Sequence: Synthetic oligonucleotide
gccctcgaacttcacctcggc

SEQ ID NO: 406 - DNA, 27 bp, Artificial Sequence
  Description of Artificial Sequence: Synthetic oligonucleotide
gccctcgaacttcacctcggcgcgggt

SEQ ID NO: 407 - DNA, 24 bp, Artificial Sequence
  Description of Artificial Sequence: Synthetic oligonucleotide
gtcgccctcgaacttcacctcggc

SEQ ID NO: 408 - DNA, 30 bp, Artificial Sequence
  Description of Artificial Sequence: Synthetic oligonucleotide
gtcgccctcgaacttcacctcggcgcgggt

SEQ ID NO: 409 - DNA, 22 bp, Artificial Sequence
  Description of Artificial Sequence: Synthetic oligonucleotide
gcaagggcgaggagctgttcac

SEQ ID NO: 410 - DNA, 28 bp, Artificial Sequence
  Description of Artificial Sequence: Synthetic oligonucleotide
gcaagggcgaggagctgttcaccggggt

SEQ ID NO: 411 - DNA, 24 bp, Artificial Sequence
  Description of Artificial Sequence: Synthetic oligonucleotide
gagcaagggcgaggagctgttcac

SEQ ID NO: 412 - DNA, 30 bp, Artificial Sequence
  Description of Artificial Sequence: Synthetic oligonucleotide
gagcaagggcgaggagctgttcaccggggt

SEQ ID NO: 413 - DNA, 24 bp, Artificial Sequence
  Description of Artificial Sequence: Synthetic oligonucleotide
gcccttcagctcgatgcggttcac

SEQ ID NO: 414 - DNA, 30 bp, Artificial Sequence
  Description of Artificial Sequence: Synthetic oligonucleotide
gcccttcagctcgatgcggttcaccagggt

SEQ ID NO: 415 - DNA, 20 bp, Artificial Sequence
  Description of Artificial Sequence: Synthetic oligonucleotide
gtctatatcatggccgacaa

SEQ ID NO: 416 - DNA, 26 bp, Artificial Sequence
  Description of Artificial Sequence: Synthetic oligonucleotide
gtctatatcatggccgacaagcagaa

SEQ ID NO: 417 - DNA, 21 bp, Artificial Sequence
  Description of Artificial Sequence: Synthetic oligonucleotide
gcagctcgccgaccactacca

SEQ ID NO: 418 - DNA, 27 bp, Artificial Sequence
  Description of Artificial Sequence: Synthetic oligonucleotide
gcagctcgccgaccactaccagcagaa

SEQ ID NO: 419 - DNA, 23 bp, Artificial Sequence
  Description of Artificial Sequence: Synthetic oligonucleotide
gtgcagctcgccgaccactacca

SEQ ID NO: 420 - DNA, 29 bp, Artificial Sequence
  Description of Artificial Sequence: Synthetic oligonucleotide
gtgcagctcgccgaccactaccagcagaa

SEQ ID NO: 421 - DNA, 21 bp, Artificial Sequence
  Description of Artificial Sequence: Synthetic oligonucleotide
gccttcgggcatggcggactt

SEQ ID NO: 422 - DNA, 27 bp, Artificial Sequence
  Description of Artificial Sequence: Synthetic oligonucleotide
gccttcgggcatggcggacttgaagaa

SEQ ID NO: 423 - DNA, 24 bp, Artificial Sequence
  Description of Artificial Sequence: Synthetic oligonucleotide
gtagccttcgggcatggcggactt

SEQ ID NO: 424 - DNA, 30 bp, Artificial Sequence
  Description of Artificial Sequence: Synthetic oligonucleotide
gtagccttcgggcatggcggacttgaagaa

SEQ ID NO: 425 - DNA, 23 bp, Artificial Sequence
  Description of Artificial Sequence: Synthetic oligonucleotide
gtctatatcatggccgacaagca

SEQ ID NO: 426 - DNA, 29 bp, Artificial Sequence
  Description of Artificial Sequence: Synthetic oligonucleotide
gtctatatcatggccgacaagcagaagaa

SEQ ID NO: 427 - DNA, 23 bp, Artificial Sequence
  Description of Artificial Sequence: Synthetic oligonucleotide
gtcttgtagttgccgtcgtcctt

SEQ ID NO: 428 - DNA, 29 bp, Artificial Sequence
  Description of Artificial Sequence: Synthetic oligonucleotide
gtcttgtagttgccgtcgtccttgaagaa

SEQ ID NO: 429 - DNA, 24 bp, Artificial Sequence
  Description of Artificial Sequence: Synthetic oligonucleotide
ggtcttgtagttgccgtcgtcctt

SEQ ID NO: 430 - DNA, 30 bp, Artificial Sequence
  Description of Artificial Sequence: Synthetic oligonucleotide
ggtcttgtagttgccgtcgtccttgaagaa

SEQ ID NO: 431 - protein, 272 aa, Artificial Sequence
  Description of Artificial Sequence: Synthetic polypeptide
KTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 432 - protein, 272 aa, Artificial Sequence
  Description of Artificial Sequence: Synthetic polypeptide
KTEVQTGGFSKESILPKRNSDKLIARKKDWDPKKYGGFYSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYISTKEVLDATLIHQSITGLYETRIDLSQLGGD

SEQ ID NO: 433 - protein, 272 aa, Artificial Sequence
  Description of Artificial Sequence: Synthetic polypeptide
KTEVQTGGFSKESILPKRNSDKLIARKKDWDPKKYGGFNSPTVAYSVLVVAKVEKGKFKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYTSTKEVLDATLIHQSITGLYETRIDLSQLGGD

SEQ ID NO: 434 - protein, 272 aa, Artificial Sequence
  Description of Artificial Sequence: Synthetic polypeptide
KTEVQTGGFSKESILPKRNSDKLIARKKDWDPKKYGGFYSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 435 - protein, 272 aa, Artificial Sequence
  Description of Artificial Sequence: Synthetic polypeptide
KTEVQTGGFSKESILPKRNSDKLIARKKDWDPKKYGGFNSPTVAYSVLVVAKVEKGKSKKLKSVKELLGITIMERSSFEKNPIDFLEAKGYKEVKKDLIIKLPKYSLFELENGRKRMLASAGELQRGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 436 - protein, 272 aa, Artificial Sequence
  Description of Artificial Sequence: Synthetic polypeptide
KTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDNPIREQAENIIHLFTLTNLGAPAAFKYFDTTIDRKRYTSTKEVLDATLIHQSITGLYETRIDLSQLGGD

SEQ ID NO: 437 - protein, 272 aa, Artificial Sequence
  Description of Artificial Sequence: Synthetic polypeptide
KTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTPIDRKRYTSTKEVLDATLIHQSITGLYETRIDLSQLGGD

SEQ ID NO: 438 - protein, 272 aa, Artificial Sequence
  Description of Artificial Sequence: Synthetic polypeptide
KTEVQTGGFSKESILPKRNSDKLIARKKDWDPKKYGGFYSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYTSTKEVLDATLIHQSITGLYETRIDLSQLGGD

SEQ ID NO: 439 - protein, 272 aa, Artificial Sequence
  Description of Artificial Sequence: Synthetic polypeptide
KTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTKLGAPAAIKYFDTTIDRKQYTSTKEVLDATLIHQSITGLYETRIDLSQLGGD

SEQ ID NO: 440 - protein, 272 aa, Artificial Sequence
  Description of Artificial Sequence: Synthetic polypeptide
KTEVQTGGFSKESILPKRNSDKLIARKKDWDPKKYGGFYSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYTSTKEVLEATLIHQSITGLYETRIDLSQLGGD

SEQ ID NO: 441 - protein, 272 aa, Artificial Sequence
  Description of Artificial Sequence: Synthetic polypeptide
KTEVQTGGFSKESILPKRNSDKLIARKKDWDPKKYGGFYSPTVAYSVLVVAKVEKGKSKKLKSVKELLGITIMERSSFEKNPMDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYTSTKEVLDATLIHQSITGLYETRIDLSQLGGD

SEQ ID NO: 442 - protein, 272 aa, Artificial Sequence
  Description of Artificial Sequence: Synthetic polypeptide
KTEVQTGGFSKESILPKRNSDKLIARKKDWDPKKYGGFVSPTVAYSVLVEAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYTSTKEVLDATLIHQSITGLYETRIDLSQLGGD

SEQ ID NO: 443 - protein, 272 aa, Artificial Sequence
  Description of Artificial Sequence: Synthetic polypeptide
KTEVQTGGFSKESILPKRNSDKLIARKKDWDPKKYGGFESPTVAYSVLVVAKVEKGKSKKLKSVKELLGITIMERSSFEKNPIDFLEAKGYKEVKKDLIIKLPKYSLFELENGRKRMLASAGELQKGNELALPFKYVNFLYLASHYEKLKGSPEDNEQKQLFVEQHKHYLDEIIEQISEFSKRVILADANLDKVLSAYNKHRDKPIREQAENIIHLFTLTNLGAPSAFKYFDTTIDRKQYRSTKEVLDATLIHQSITGLYETRIDLSQLGGD

SEQ ID NO: 444 - protein, 272 aa, Artificial Sequence
  Description of Artificial Sequence: Synthetic polypeptide
KTEVQTGGFSKESIFPKRNSDKLIARKKDWDPKKYGGLYSPTVAYSVLVVAKVEKGKSKKLKSVKELLGITIMERSSFEKNPIDFLEAKGYKEIKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYTSTKEVLDATLIHQSITGLYETRIDLSQLGGD

SEQ ID NO: 445 - protein, 272 aa, Artificial Sequence
  Description of Artificial Sequence: Synthetic polypeptide
KTEVQTGGFSKESILPKRNSDKLIARKKDWDPKKYGGFYSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDKEQKQLFVEQHKHYLDEIIEQISEFSKRVILADANLDKVLSAYNKHRDKPIREQAENIIHLFTLTNLGAPAAFKYFDTTIDRKQYTSTKEVLDATLIHQSITGLYETRIDLSQLGGD

SEQ ID NO: 446 - protein, 272 aa, Artificial Sequence
  Description of Artificial Sequence: Synthetic polypeptide
KTEVQTGGFSKESILPKRNSDKLIARKKDWDPKKYGGFYSPTVAYSVLVVAKVEKGKSKKLKSVKELLGITIMERSSFEKNPIDFLEAKGYKEVKEDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPICEQAENIIHLFTLTNLGAPAAFKYFDTTIDRKQYTSTKEVLDATLIHQSITGLYETRIDLSQLGGD

SEQ ID NO: 447 - protein, 272 aa, Artificial Sequence
  Description of Artificial Sequence: Synthetic polypeptide
KTEVQTGGFSKESILPKRNSDKLIARKKDWDPKKYGGFYSPTVAYSVLVVAKVENRKSKKLKSVKELLGITIMERSSFEKNPIDFLEAKGYKEVKKDLIIKLPKYSLFELENGRKRMLASARELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDATIDRKQYTSTKEVLDATLIHQSITGLYETRIDLSQLGGD

SEQ ID NO: 448 - protein, 272 aa, Artificial Sequence
  Description of Artificial Sequence: Synthetic polypeptide
KTEVQTGGFSKESILPKRNSDKLIARKKDWDPKKYGGFVSPTVAYSVLVVANVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILTDANLDKVLSAYNKHRDKPIREQAENIIHLFTLTNLGAPAAFKYFDTTIDRKQYTSTKEVLDATLIHQSITGLYETRIDLSQLGGD

SEQ ID NO: 449 - protein, 272 aa, Artificial Sequence
  Description of Artificial Sequence: Synthetic polypeptide
KTEVQTGGFSKESILPKRNSDKLIARKKDWDPKKYGGFYSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSLEDNEQKQLFVEQHRHYLDEIIEQISEFSKRVILADANLDKVLSAYNKYRDKPIREQAENIIHLFTLTNLGAPAAFKYFDTTIDRKQYTSTKEVLDATLIHQSITGLYETRIDLSQLGGD

SEQ ID NO: 450 - protein, 272 aa, Artificial Sequence
  Description of Artificial Sequence: Synthetic polypeptide
KTEVQTGGFSKESILPKRNSDKLIARKKVWDPKKYGGFYSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYTSTKEVLDATLIHQSITGLYETRIDLSQLGGD

SEQ ID NO: 451 - protein, 272 aa, Artificial Sequence
  Description of Artificial Sequence: Synthetic polypeptide
KTEVQTGGFSKESILPKRNSDKLIARKKDWDPKKYGGFYSPTVAYSILVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYTSTKEVLDATLIHQSITGLYETRIDLSQLGGD

SEQ ID NO: 452 - protein, 272 aa, Artificial Sequence
  Description of Artificial Sequence: Synthetic polypeptide
KTEVQTGRFSKESILPKRNSDKLIARKKDWDPKKYGGFNSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYTSTKEVLDATLIHQSITGLYETRIDLSQLGGD

SEQ ID NO: 453 - protein, 272 aa, Artificial Sequence
  Description of Artificial Sequence: Synthetic polypeptide
KTEVQTGGFSKESILPKRNSDKLIARKKDWDPKKYGGFYSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIHEQAENIIHLFTLTNLGAPAAFKYFDTTIDRKQYTSTKEVLDATLIHQSITGLYETRIDLSQLGGD

SEQ ID NO: 454 - protein, 272 aa, Artificial Sequence; identical to SEQ ID NO: 438
  Description of Artificial Sequence: Synthetic polypeptide

SEQ ID NO: 455 - protein, 272 aa, Artificial Sequence
  Description of Artificial Sequence: Synthetic polypeptide
KTEVQTGGFSKESILPKRNSDKLIARKKDWDPKKYGGFYSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRNKPIREQAENIIHLFTLTNLGAPAAFKYFDTMIDRKQYTSTKEVLDATLIHQSITGLYETRIDLSQLVGD

SEQ ID NO: 456 - protein, 272 aa, Artificial Sequence
  Description of Artificial Sequence: Synthetic polypeptide
KTEVQTGGFSKESILPKRNSDKLIARKKDWDPKKYGGFYSPTVAYSVLVVAKVEKGKSRKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYTSTKEVLDATLIHQSITGLYETRIDLSQLGGD

SEQ ID NO: 457 - protein, 272 aa, Artificial Sequence
  Description of Artificial Sequence: Synthetic polypeptide
KTEVQTGGFSKESILPKRNSDKLIARKKDWDPKKYGGFYSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYTSTKEVLDATLIHQSITGLYETRIDLSLLGGD

SEQ ID NO: 458 - protein, 272 aa, Artificial Sequence
  Description of Artificial Sequence: Synthetic polypeptide
KTEVQTGGFSKESILPNRNSDKLIARKKDWDPKKYGGFDSPTVAYSVLVVAKVEKGKSKKLKSVKELLGITIMERSSFEKKPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGD

SEQ ID NO: 459 - protein, 272 aa, Artificial Sequence
  Description of Artificial Sequence: Synthetic polypeptide
KTEVQTGGFSKESILPKRNSDKLIARKKDWDPKKYGGFYSPTVAYSVLVVAKVKKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYTSTKEVLDATLIHQSITGLYETRIDLSQLGGD

SEQ ID NO: 460 - protein, 272 aa, Artificial Sequence
  Description of Artificial Sequence: Synthetic polypeptide
KTEVQTGGFSKESILPKRNSDKLIARKKDWDPKKYGGFNSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYTSTKEVLDATLIHQSITGLYETRIDLSQLGGD

SEQ ID NO: 461 - protein, 272 aa, Artificial Sequence
  Description of Artificial Sequence: Synthetic polypeptide
ETEVQTGGFSKESILPKRNSDKLIARKKDWDPKKYGGFDSPTVAFSVLVVAKVEKGKSKKLKSVKELLGITIMERSFFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYTSTKEVLDATLIHQSITGLYETRIDLSQLGGD

SEQ ID NO: 462 - protein, 272 aa, Artificial Sequence
  Description of Artificial Sequence: Synthetic polypeptide
KTEVQTGGFSKESILPKRNSDKLIARKKDWDPKKYGGFYSPTVAYSVLVVAKVEKGKSKKLKSVKDLLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILVDANLDKVLSAYNKHRDKPIREQAENIIHLFTLTNLGAPAAFKYFDTTIDRKQYTSTKEVLDATLIHQSITGLYETRIDLSQLGGD

SEQ ID NO: 463 - protein, 272 aa, Artificial Sequence
  Description of Artificial Sequence: Synthetic polypeptide
KTEVQTGGFSKESILPKRNSDKLIARKKDWDPKKYGGFDSPTVAYSVLVVAKVEKGKSKKLKSVKELLGITNMERSSFEKNPIDFLEAKGYKEVKKDLIIKLPKYSLFELENGRKRMLASAEELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDATIDRKQYRSTKEVLDATLIHQSITGLYETRIDLSQLGGD

SEQ ID NO: 464 - protein, 272 aa, Artificial Sequence
  Description of Artificial Sequence: Synthetic polypeptide
KTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIYRKQYTSTKEVLDATLIHQSITGLYETRIDLSQLGGD

SEQ ID NO: 465 - protein, 272 aa, Artificial Sequence
  Description of Artificial Sequence: Synthetic polypeptide
KTEVQTGGFSKESILPKRNSDKLIARKKDWDPKKYGGFYSPTVAYSVLVVANVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTDLGAPAAFKYFDTTIDRKQYTSTKEVLDATLIHQSITGLYETRIDLSQLGGD

SEQ ID NO: 466 - protein, 272 aa, Artificial Sequence
  Description of Artificial Sequence: Synthetic polypeptide
KTEVQTGGFSKESILPKRNSDKLIARKKDWDPKKYGGFNSPTVAYSVLVVAKVEKGKSKKLKSVKELLGITIMERSSFEKNPIDFLEAKGYKEVKKDLIIKLPKYSLFELENGRKRMLASARELQKGNELALPSKYVNFLYLASHYEKLKGSPEDNEQKQFFVEQHKHYLDEIIEQISEFSKRVILADANLDKVLSAYNKHRDKPIREQAENIIHLFTLTNLGAPAAFKYFDTTIDRKEYRSTKEVLDATLIHQSITGLYETRIDLSQLGGD

SEQ ID NO: 467 - protein, 272 aa, Artificial Sequence
  Description of Artificial Sequence: Synthetic polypeptide
KTEMQTGGFSKESVLPKRNSDKLIARKKDWDPKKYGGFNSPTVAYSVLVVAKVEKGKSKRLKSVKELLGITIMERSSFEKNPIDFLEAKGYKEVKKDLIIKLPKYSLFELENGRKRMLASAGVLQKGNELALPSKYVNFLYLASHYEKLKGSPDDNEQKRLFVEQHKHYLDEIIEQISEFSKRVILADANRDKVLSAYNKHRDKPIREQAENIIHLFTLTNLGAPAAFKYFDTTIDRKEYRSTKEVLDATLIHQSITGLYETRIDLSQLGGD

SEQ ID NO: 468 - protein, 272 aa, Artificial Sequence
  Description of Artificial Sequence: Synthetic polypeptide
KTEVQTGGFSKESILPKRNSDKLIARKKDWDPKKYGGFYSPTVAYSVLVVAKVEKGKSKKLKSVKELLGITIMERSSFEENPIDFLEAKGYKEVKKDLIIKLPKYSLFELENGRKRMLASAGELQKGNELALPSKYVNFLYLASHYEKLKGSPKDNEQKQLFVEKHKHYLDEIIEQISEFSKRVILADANLDKVLSAYNKHRDKPIREQAENIIHLFTLTNLGAPAAFKYFDTTIDRKEYRSTKEVLDATLIHQSITGLYETRIDLSQLGGD

SEQ ID NO: 469 - protein, 272 aa, Artificial Sequence
  Description of Artificial Sequence: Synthetic polypeptide
KTEVQTGGFSKESILPKRNSDKLIARKKDWDPKKYGGFNSPTVAYSVLVVANVEKGKSKKLKSVKELLGITIMERSSYEKNPIDFLEAKGYKEVKKDLIIKLPKYSLFELENGRKRMLASAGVLQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKEYRSTKEVLDATLIHQSITGLYETRIDLSQLGGD

SEQ ID NO: 470 - protein, 272 aa, Artificial Sequence
  Description of Artificial Sequence: Synthetic polypeptide
KTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSFTGLYETRIDLSQLGGD

SEQ ID NO: 471 - protein, 272 aa, Artificial Sequence
  Description of Artificial Sequence: Synthetic polypeptide
KTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLLIKLPKYSLFELENGRKRMLASARELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKEYRSTKEVLDATLIHQSITGLYETRIDLSQLGGD

SEQ ID NO: 472 - protein, 272 aa, Artificial Sequence
  Description of Artificial Sequence: Synthetic polypeptide
KTEVQTGGFSKESILPKRNSDKLIARKKDWDPKKYGGFNSPTVAYSVLVVAKDEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPICEQAENIIHLFTLTKLGAPAAFKYFDTTIDRKEYRSTKEVLDATLIHQSITGLYETRIDLSQLGGD

SEQ ID NO: 473 - protein, 272 aa, Artificial Sequence
  Description of Artificial Sequence: Synthetic polypeptide
KTEVQTGGFSKESILPKRNSDKVIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKEYRSTKEVLDATLIHQSITGLYETRIDLSQLGGD

SEQ ID NO: 474 - protein, 272 aa, Artificial Sequence
  Description of Artificial Sequence: Synthetic polypeptide
KTEVQTGGFSKESILPKRNSDKLIARKKDWDPKKYGGFYSPIVAYSVLVVAKVEKGKSKKLKSVKELLGITIMERSSFEKNPIDFLEAKGYKEVKKDLIIKLPKYSLFELENGRKRMLASAGVLQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKEYRSTKEVLDATLIHQSITGLYETRIDLSQLGGD

SEQ ID NO: 475 - protein, 272 aa, Artificial Sequence
  Description of Artificial Sequence: Synthetic polypeptide
KTEVQTGGFSKESILPKRNSDKLIARKKDWDPKKYGGFYSPTVAYSVLVVAKVEKGKSKKLKSVKELLGITIMERSSFEKNPIDFLEAKGYKEIKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKTIREQAENTIHLFTLTNLGAPAAFKYFDTTIDRKEYRSTKEVLDATLIHQSITGLYETRIDLSQLGGD

SEQ ID NO: 476 - protein, 272 aa, Artificial Sequence
  Description of Artificial Sequence: Synthetic polypeptide
KTEVQTGGFSKESILPKRNSDKLIARKKDWDPKKYGGFYSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKEYRSTKEVLDATLIHHSITGLYETRIDLSQLGGD

SEQ ID NO: 477 - protein, 272 aa, Artificial Sequence
  Description of Artificial Sequence: Synthetic polypeptide
KTEVQTGGFSKESILPKRNSDKLIARKKDWDPKKYGGFYSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADGNLDKVLSAYNKHRDKPIREQAENIIHLFTLTNLGAPAAFKYFDTTIDRKEYRSTKEVLDATLIHQSITGLYETRIDLSQLGGD

SEQ ID NO: 478 - protein, 272 aa, Artificial Sequence
  Description of Artificial Sequence: Synthetic polypeptide
KTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLLIKLPKYNLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGD

SEQ ID NO: 479 - protein, 272 aa, Artificial Sequence
  Description of Artificial Sequence: Synthetic polypeptide
KTEVQTGGFSKESILPKRNSDKLIARKKDWDPKKYGGFNSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPDYNEQKQLFVEQHKHYLDEIIEQISEFSKRVILADANLDKVLSAYNKHRDKPIREQAENIIHLFTLTNLGAPAAFKYFDTTIDRKEYRSTKEVLDATLIHQSITGLYETRIDLSQLGGD

SEQ ID NO: 480 - protein, 272 aa, Artificial Sequence
  Description of Artificial Sequence: Synthetic polypeptide
KTEVQTGGFSKESILPKRNSDKLIARKKDWDPKKYGGFDSPKVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDMSQLGGD

SEQ ID NO: 481 - protein, 272 aa, Artificial Sequence
  Description of Artificial Sequence: Synthetic polypeptide
KTEVQTGGFSKESILPKRNSDKLIARKKDWDPKKYGGFYSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLIAYNKHRDKPIREQAENIIHLFTLTNLGAPAAFKYFDTTIDRKEYRSTKEVLDATLIHQSITGLYETRIDLSQLGGD

SEQ ID NO: 482 - protein, 272 aa, Artificial Sequence
  Description of Artificial Sequence: Synthetic polypeptide
KTEEQTGGFSKESIHPKRNSDKLIARKKDWDPKKYGGFHSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNMHRDKPIREQAENIIHLFTLTNLGAPAAFKYFDTTIDRKEYRSTKEVLDATLIHQSITGLYETRIDLSQLEGD

SEQ ID NO: 483 - protein, 272 aa, Artificial Sequence
  Description of Artificial Sequence: Synthetic polypeptide
KTEVQTGGFSKESILPKRNSDKLIARKKDWDPKKYGGFYSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQMQLFVEQHKHYLDEIIEQISEFSKRVILADANLDKVLSAYNKHRDKPIREQAENIIHLFTLTNLGAPAAFKYFDTTIDRKEYRSTKEVLDATLIHQSITGLYETRIDLSQLGGD

SEQ ID NO: 484 - protein, 272 aa, Artificial Sequence
  Description of Artificial Sequence: Synthetic polypeptide
KTEVQTGRFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKEYRSTKEVLDATLIHQSITGLYETRIDLSQLGGD

SEQ ID NO: 485 - protein, 272 aa, Artificial Sequence
  Description of Artificial Sequence: Synthetic polypeptide
KTEVQTGGFSKESILPKRNSDKLIARKKDWDPKKYGGFDSPTVAYSVLVVAKVEKGKSKKVKSVKELLGITIMERSSFEKNPIDFLEAKGYKEVKKDLIIKLPKYSLFELENGRKRMLASAGVLQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKEYRSTKEVLDATLIHQSITGLYETRIDLSQLGGD

SEQ ID NO: 486 - protein, 272 aa, Artificial Sequence
  Description of Artificial Sequence: Synthetic polypeptide
KTEVQTGGFSKESILPKRNSDKLIARKKDWDPKKYGGFYSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHFEKLKGSPEDNEQKQLFVEQHKHYLDEIIEQISEFSKRVILADANLDKVLSAYNKHRDKPIREQAENIIHLFTLTNLGAPAAFKYFDTMIDRKEYRSTKEVLDATLIHQSITGLYETRIDLSQLGGD

SEQ ID NO: 487 - protein, 272 aa, Artificial Sequence
  Description of Artificial Sequence: Synthetic polypeptide
KTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQPKHYLDEIIEQISEFSKRVILADANLDKVLSAYNKHRDKPIREQAENIIHLFTLTNLGAPAAFKYFDTTIDRKEYRSTKEVLDATLIHQSITGLYETRIDLSQLGGD

SEQ ID NO: 488 - protein, 272 aa, Artificial Sequence
  Description of Artificial Sequence: Synthetic polypeptide
KTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASAGELQKGNEIALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTKIDRKEYRSTKEVLDATLIHQSITGLYETRIDLSQLGGD

SEQ ID NO: 489 - protein, 272 aa, Artificial Sequence
  Description of Artificial Sequence: Synthetic polypeptide
KTEVQTGGFSKESILPKRNSDKLIARKKDWDPKKYGGFYSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKEYRSTKEVLDATLIHQSITGLYETRIDLSQLGGD

SEQ ID NO: 490 - protein, 272 aa, Artificial Sequence
  Description of Artificial Sequence: Synthetic polypeptide
KTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGVLQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKEYRSTKEVLDATLIHQSITGLYETRIDLSQLGGD

SEQ ID NO: 491 - protein, 272 aa, Artificial Sequence; identical to SEQ ID NO: 489
  Description of Artificial Sequence: Synthetic polypeptide

SEQ ID NO: 492 - protein, 272 aa, Artificial Sequence; identical to SEQ ID NO: 489
  Description of Artificial Sequence: Synthetic polypeptide

SEQ ID NO: 493 - protein, 272 aa, Artificial Sequence
  Description of Artificial Sequence: Synthetic polypeptide
KTEVQTGGFSKESILPKRNSDKLIARKKDWDPKKYGGFDSPTVAYSVLVVAKVEKGKSKKLKSVKELLGITIMERSSFEKNPFDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADPNLDKVLSAYNKHRDKPIREQAENIIHLFTLTNLGAPAAFKYFDTTIDRKEYRSTKEVLDATLIHQSITGLYETRIDLSQLGGD

SEQ ID NO: 494 - protein, 272 aa, Artificial Sequence
  Description of Artificial Sequence: Synthetic polypeptide
KTEVQTGGFSKESILPKRNSDKLIARKKDWDPKKYGGFLSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKEYRSTKEVLDATLIHQSITGLYETRIDLSQLGGD

SEQ ID NO: 495 - protein, 272 aa, Artificial Sequence
  Description of Artificial Sequence: Synthetic polypeptide
KTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKEYRSTKEVLDATLIHQSITGLYETRIDLSQLGGD

SEQ ID NO: 496 - protein, 272 aa, Artificial Sequence
  Description of Artificial Sequence: Synthetic polypeptide
KTEVQTGGFSKESILPKRNSDKLIARKKDWDPKKYGGFYSPTVAYSVLVVAKVEKGKSKKLKSVIELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKEYRSTKEVLDATLIHQSITGLYETRIDLSQLGGD

SEQ ID NO: 497 - protein, 272 aa, Artificial Sequence; identical to SEQ ID NO: 489
  Description of Artificial Sequence: Synthetic polypeptide

SEQ ID NO: 498 - protein, 272 aa, Artificial Sequence
  Description of Artificial Sequence: Synthetic polypeptide
KTEVQTGGFSKESILPKRNSDKLIARKKDWDPKKYGGFDSPTVAYSVLVVAKVEKGKTKKLKSVKELLGITIMERSSFEKNPIDFLEAKGYKEVIKDFIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSPKEVLDATLIHQSITGLYETRIDLSQLGGD

SEQ ID NO: 499 - protein, 272 aa, Artificial Sequence; identical to SEQ ID NO: 489
  Description of Artificial Sequence: Synthetic polypeptide

SEQ ID NO: 500 - protein, 272 aa, Artificial Sequence
  Description of Artificial Sequence: Synthetic polypeptide
KTEVQTGGFSKESILPKRNSDKLIARKKDWDPKKYGGFYSPTVAYSVPVVAKVEKGKSKKLKSVKELLGITIMERSSFEKNPIDFLEAKGYKEVKKDLIIKLPKYSLFELESGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKEYRSTKEVLDATLIHQSITGLYETRIDLSQLGGD

SEQ ID NO: 501 - protein, 272 aa, Artificial Sequence
  Description of Artificial Sequence: Synthetic polypeptide
KTEVQTGGFSKESILPKRNSDKLIARKKDWDPKKYGGFYSPTVAYSVLVVAKVEKGKSKKLKSVKELLGITIMERSSFEKNPIDFLEAKGYKEVNKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKTYRSTKEVLDATLIHQSITGLYETRIDLSQLGGD

SEQ ID NO: 502 - protein, 272 aa, Artificial Sequence
  Description of Artificial Sequence: Synthetic polypeptide
KTEVQTGGFSKESILPKRNSDKLIARKKDWDPKKYGGFYSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIHEQAENIIHLFTLTNLGAPAAFKYFDTTIDRKTYRSTKEVLDATLIHQSITGLYETRIDLSQLGGD

SEQ ID NO: 503 - protein, 272 aa, Artificial Sequence
  Description of Artificial Sequence: Synthetic polypeptide
KTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLMIKLPKYSLFELKNGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTKLGAPAAFKYFDTTIDRKTYRSTKEVLDATLIHHSITGLYETRIDLSQLGGD

SEQ ID NO: 504 - protein, 272 aa, Artificial Sequence
  Description of Artificial Sequence: Synthetic polypeptide
KTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASARELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKTYRSTKEVLDATLIHQSITGLYETRIDLSQLGGD

SEQ ID NO: 505 - protein, 272 aa, Artificial Sequence
  Description of Artificial Sequence: Synthetic polypeptide
KTEVQTGGFSKESILPKRNSDKLIARKKDWDPKKYGGLYSPTVAYSVLVVAKVEKGKSKKLKSVKELLGITIMERSSFEKNPIDFLEAKGYKEVKRDLIIKLPKYSLFELKNGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKTYRSTKEVVDATLIHQSITGLYETRIDLSQLGGD

SEQ ID NO: 506 - protein, 272 aa, Artificial Sequence
  Description of Artificial Sequence: Synthetic polypeptide
KTEVQTGGFSKESIHPKRNSDKLIARKKDWDPKKYGGFNSPTVAYSVLVVAKVEKGKSKKLKSVKELLGITIMERSSFEKNPIDFLEAKGYKEVKKDLIITLPKYSLFELENGRKRMLASAGELQKGNELALPSKYVNFLYLASHYEKLKGSPEDNEQKQLFVEQHKHYLDEIIEQISEFSKRVILADSNLDKVLSAYNKHRDKPIREQAENIIHLFTLTNLGAPAAFKYFDTTIDRKTYRSTKEVLDATLIHQSITGLYETRIDLSQLGGD

SEQ ID NO: 507 - protein, 272 aa, Artificial Sequence
  Description of Artificial Sequence: Synthetic polypeptide
KTEVQTGGFSKESILPKGNSDKLIARKKDWDPKKYGGFNSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKTYRSTKEVLDATLIHQSITGLYETRIDLSQLGGD

SEQ ID NO: 508 - protein, 272 aa, Artificial Sequence
  Description of Artificial Sequence: Synthetic polypeptide
KTEVQTGGFSKESILPKRNSDKLIARKKDWDPKKYGGFDSPTVAYSVLVVAKVEKGKSKKLKSVKDLLGITIMERSSFEKNPIDFLEAKGYKEVKKDLMIKLPKYSLFELENGRKRMLASARELQKGNELALPSKYVNFLYLASHYEKLKGSPEDNEQKQLFVEQHKHYLDEIIEQISEFSKRVILADANLDKVLSAYNKHRDKPIREQAENIVHLFTLTNLGAPAAFKYFDTTIDRKTYRSTKEVLDATLIHQSITGLYETRIDLSQLGGD

SEQ ID NO: 509 - protein, 272 aa, Artificial Sequence
  Description of Artificial Sequence: Synthetic polypeptide
KTEVQTGGFSKESILPKRNSDKLIARKKDWDPKKYGGFNSPTVAYSVLVVAKVEKGKSKKLKSVKELLGITIMERSSFEKNPIDFLEAKGYKEIKKDLIIKLPKYSLFELENGRKRMLASAGELQKGNELALPSKYVNFLYLASHYEKLKGSPEDNEQKQLFVEQHKHYLDEIIEQISEFSKRVILADVNLDKVLSAYNKHRDKPIREQAENIIHLFTLTNLGAPAAFKYFDTTIDRKTYRSTKEVLDATLIHQSITGLYETRIDLSQLGGD

SEQ ID NO: 510 - protein, 272 aa, Artificial Sequence
  Description of Artificial Sequence: Synthetic polypeptide
KTEVQTGGFSKESIHPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASARELQKGNELALPSKYVNFLYLASHYEKLKGSPEDNEQKQLFVEQHKHYLDEIIEQISEFSKRVILADANLDKVLSAYNKDRDKPIREQAENIIHLFTLTNLGAPAAFKYFDTTIDRKTYRSTKEVLDATLIHQSITGLYETRIDLSQLGGD

SEQ ID NO: 511 - DNA, 6 bp, Artificial Sequence
  Description of Artificial Sequence: Synthetic oligonucleotide
  modified_base (1)..(2): a, c, t, g, unknown or other
nncagt

SEQ ID NO: 512 - DNA, 6 bp, Artificial Sequence
  Description of Artificial Sequence: Synthetic oligonucleotide
  modified_base (1)..(2): a, c, t, g, unknown or other
nncggt

SEQ ID NO: 513 - DNA, 6 bp, Artificial Sequence
  Description of Artificial Sequence: Synthetic oligonucleotide
  modified_base (1)..(2): a, c, t, g, unknown or other
nntagt

SEQ ID NO: 514 - DNA, 6 bp, Artificial Sequence
  Description of Artificial Sequence: Synthetic oligonucleotide
  modified_base (1)..(2): a, c, t, g, unknown or other
nntggt

SEQ ID NO: 515 - DNA, 50 bp, Artificial Sequence
  Description of Artificial Sequence: Synthetic oligonucleotide
ctagagggtgggcgggagggtcgccctcgaacttcaccttggagtgcatg

SEQ ID NO: 516 - DNA, 42 bp, Artificial Sequence
  Description of Artificial Sequence: Synthetic oligonucleotide
cactccaaggtgaagttcgagggcgaccctcccgcccaccct

SEQ ID NO: 517 - DNA, 67 bp, Artificial Sequence
  Description of Artificial Sequence: Synthetic oligonucleotide
  modified_base (36)..(43): a, c, t, g, unknown or other
  modified_base (46)..(48): a, c, t, g, unknown or other
gcaggaattcgggaggggcacgggcagcttgccggnnnnnnnnctnnngcgcaggtcacgaggcatg

SEQ ID NO: 518 - DNA, 67 bp, Artificial Sequence
  Description of Artificial Sequence: Synthetic oligonucleotide
  modified_base (36)..(43): a, c, t, g, unknown or other
  modified_base (46)..(48): a, c, t, g, unknown or other
gcaggaattcggagggtcgccctcgaacttcacctnnnnnnnnctnnngcgcaggtcacgaggcatg

SEQ ID NO: 519 - DNA, 21 bp, Artificial Sequence
  Description of Artificial Sequence: Synthetic oligonucleotide
gttgtactccagcttgtgccc

SEQ ID NO: 520 - DNA, 27 bp, Artificial Sequence
  Description of Artificial Sequence: Synthetic oligonucleotide
gttgtactccagcttgtgccccaggat

SEQ ID NO: 521 - DNA, 20 bp, Artificial Sequence
  Description of Artificial Sequence: Synthetic oligonucleotide
ggacggcgacgtaaacggcc

SEQ ID NO: 522 - DNA, 26 bp, Artificial Sequence
  Description of Artificial Sequence: Synthetic oligonucleotide
ggacggcgacgtaaacggccacaagt

SEQ ID NO: 523 - DNA, 21 bp, Artificial Sequence
  Description of Artificial Sequence: Synthetic oligonucleotide
gaacttcagggtcagcttgcc

SEQ ID NO: 524 - DNA, 27 bp, Artificial Sequence
  Description of Artificial Sequence: Synthetic oligonucleotide
gaacttcagggtcagcttgccgtaggt

SEQ ID NO: 525 - DNA, 20 bp, Artificial Sequence
  Description of Artificial Sequence: Synthetic oligonucleotide
gtcgatgcccttcagctcga

SEQ ID NO: 526 - DNA, 26 bp, Artificial Sequence
  Description of Artificial Sequence: Synthetic oligonucleotide
gtcgatgcccttcagctcgatgcggt

SEQ ID NO: 527 - DNA, 22 bp, Artificial Sequence
  Description of Artificial Sequence: Synthetic oligonucleotide
gtgaccaccctgacctacggcg

SEQ ID NO: 528 - DNA, 28 bp, Artificial Sequence
  Description of Artificial Sequence: Synthetic oligonucleotide
gtgaccaccctgacctacggcgtgcagt

SEQ ID NO: 529 - DNA, 20 bp, Artificial Sequence
  Description of Artificial Sequence: Synthetic oligonucleotide
gatatagacgttgtggctgt

SEQ ID NO: 530 - DNA, 26 bp, Artificial Sequence
  Description of Artificial Sequence: Synthetic oligonucleotide
gatatagacgttgtggctgttgtagt

SEQ ID NO: 531 - DNA, 21 bp, Artificial Sequence
  Description of Artificial Sequence: Synthetic oligonucleotide
ggtgaagttcgagggcgacac

SEQ ID NO: 532 - DNA, 27 bp, Artificial Sequence
  Description of Artificial Sequence: Synthetic oligonucleotide
ggtgaagttcgagggcgacaccctggt

SEQ ID NO: 533 - DNA, 26 bp, Artificial Sequence
  Description of Artificial Sequence: Synthetic oligonucleotide
gcgtgtccggcgagggcgagggcgat

SEQ ID NO: 534 - DNA, 22 bp, Artificial Sequence
  Description of Artificial Sequence: Synthetic oligonucleotide
gctcgaccaggatgggcaccac

SEQ ID NO: 535 - DNA, 28 bp, Artificial Sequence
  Description of Artificial Sequence: Synthetic oligonucleotide
gctcgaccaggatgggcaccaccccggt

SEQ ID NO: 536 - DNA, 21 bp, Artificial Sequence
  Description of Artificial Sequence: Synthetic oligonucleotide
gggcgaggagctgttcaccgg

SEQ ID NO: 537 - DNA, 27 bp, Artificial Sequence
  Description of Artificial Sequence: Synthetic oligonucleotide
gggcgaggagctgttcaccggggtggt

SEQ ID NO: 538 - DNA, 21 bp, Artificial Sequence
  Description of Artificial Sequence: Synthetic oligonucleotide
gcactgcacgccgtaggtcag

SEQ ID NO: 539 - DNA, 27 bp, Artificial Sequence
  Description of Artificial Sequence: Synthetic oligonucleotide
gcactgcacgccgtaggtcagggtggt

SEQ ID NO: 540 - DNA, 22 bp, Artificial Sequence
  Description of Artificial Sequence: Synthetic oligonucleotide
gtgtggttccagaaccggagga

SEQ ID NO: 541 - DNA, 28 bp, Artificial Sequence
  Description of Artificial Sequence: Synthetic oligonucleotide
gtgtggttccagaaccggaggacaaagt

SEQ ID NO: 542 - DNA, 21 bp, Artificial Sequence
  Description of Artificial Sequence: Synthetic oligonucleotide
gcaggctctccgaggagaagg

SEQ ID NO: 543 - DNA, 27 bp, Artificial Sequence
  Description of Artificial Sequence: Synthetic oligonucleotide
gcaggctctccgaggagaaggccaagt

SEQ ID NO: 544 - DNA, 23 bp, Artificial Sequence
  Description of Artificial Sequence: Synthetic oligonucleotide
gcccctccctccctggcccaggt

SEQ ID NO: 545 - DNA, 29 bp, Artificial Sequence
  Description of Artificial Sequence: Synthetic oligonucleotide
gcccctccctccctggcccaggtgaaggt

SEQ ID NO: 546 - DNA, 21 bp, Artificial Sequence
  Description of Artificial Sequence: Synthetic oligonucleotide
gctcagcctgagtgttgaggc

SEQ ID NO: 547 - DNA, 27 bp, Artificial Sequence
  Description of Artificial Sequence: Synthetic oligonucleotide
gctcagcctgagtgttgaggccccagt

SEQ ID NO: 548 - DNA, 22 bp, Artificial Sequence
  Description of Artificial Sequence: Synthetic oligonucleotide
gcctgcttcgtggcaatgcgcc

SEQ ID NO: 549 - DNA, 28 bp, Artificial Sequence
  Description of Artificial Sequence: Synthetic oligonucleotide
gcctgcttcgtggcaatgcgccaccggt

SEQ ID NO: 550 - DNA, 21 bp, Artificial Sequence
  Description of Artificial Sequence: Synthetic oligonucleotide
gcaaccacaaacccacgaggg

SEQ ID NO: 551 - DNA, 27 bp, Artificial Sequence
  Description of Artificial Sequence: Synthetic oligonucleotide
gcaaccacaaacccacgagggcagagt

SEQ ID NO: 552 - DNA, 21 bp, Artificial Sequence
  Description of Artificial Sequence: Synthetic oligonucleotide
ggcctccccaaagcctggcca

SEQ ID NO: 553 - DNA, 27 bp, Artificial Sequence
  Description of Artificial Sequence: Synthetic oligonucleotide
ggcctccccaaagcctggccagggagt

SEQ ID NO: 554 - DNA, 23 bp, Artificial Sequence
  Description of Artificial Sequence: Synthetic oligonucleotide
gcagaagctggaggaggaagggc

SEQ ID NO: 555 - DNA, 29 bp, Artificial Sequence
  Description of Artificial Sequence: Synthetic oligonucleotide
gcagaagctggaggaggaagggcctgagt

SEQ ID NO: 556 - DNA, 22 bp, Artificial Sequence
  Description of Artificial Sequence: Synthetic oligonucleotide
gcttcgtggcaatgcgccaccg

SEQ ID NO: 557 - DNA, 28 bp, Artificial Sequence
  Description of Artificial Sequence: Synthetic oligonucleotide
gcttcgtggcaatgcgccaccggttgat

SEQ ID NO: 558 - DNA, 21 bp, Artificial Sequence
  Description of Artificial Sequence: Synthetic oligonucleotide
ggctctccgaggagaaggcca

SEQ ID NO: 559 - DNA, 27 bp, Artificial Sequence
  Description of Artificial Sequence: Synthetic oligonucleotide
ggctctccgaggagaaggccaagtggt

SEQ ID NO: 560 - DNA, 22 bp, Artificial Sequence
  Description of Artificial Sequence: Synthetic oligonucleotide
gcctctctgcaatgctattggt

SEQ ID NO: 561 - DNA, 28 bp, Artificial Sequence
  Description of Artificial Sequence: Synthetic oligonucleotide
gcctctctgcaatgctattggtcgaaat

SEQ ID NO: 562 - DNA, 21 bp, Artificial Sequence
  Description of Artificial Sequence: Synthetic oligonucleotide
gcgtactgattggaacatccg

SEQ ID NO: 563 - DNA, 27 bp, Artificial Sequence
  Description of Artificial Sequence: Synthetic oligonucleotide
gcgtactgattggaacatccgcgaaat

SEQ ID NO: 564 - DNA, 23 bp, Artificial Sequence
  Description of Artificial Sequence: Synthetic oligonucleotide
gacgtcacagtgaccgagggcct

SEQ ID NO: 565 - DNA, 29 bp, Artificial Sequence
  Description of Artificial Sequence: Synthetic oligonucleotide
gacgtcacagtgaccgagggcctggaagt

SEQ ID NO: 566 - DNA, 23 bp, Artificial Sequence
  Description of Artificial Sequence: Synthetic oligonucleotide
gcccggcgcacggtggcggggtc

SEQ ID NO: 567 - DNA, 29 bp, Artificial Sequence
  Description of Artificial Sequence: Synthetic oligonucleotide
gcccggcgcacggtggcggggtcccaggt

SEQ ID NO: 568 - DNA, 21 bp, Artificial Sequence
  Description of Artificial Sequence: Synthetic oligonucleotide
ggcggggtcccaggtgctgac

SEQ ID NO: 569 - DNA, 27 bp, Artificial Sequence
  Description of Artificial Sequence: Synthetic oligonucleotide
ggcggggtcccaggtgctgacgtaggt

SEQ ID NO: 570 - DNA, 21 bp, Artificial Sequence
  Description of Artificial Sequence: Synthetic oligonucleotide
ggcgtatcatttcgcggatgt

SEQ ID NO: 571 - DNA, 27 bp, Artificial Sequence
  Description of Artificial Sequence: Synthetic oligonucleotide
ggcgtatcatttcgcggatgttccaat

SEQ ID NO: 572 - DNA, 22 bp, Artificial Sequence
  Description of Artificial Sequence: Synthetic oligonucleotide
gagaccgccagaagctcggaaa

SEQ ID NO: 573 - DNA, 28 bp, Artificial Sequence
  Description of Artificial Sequence: Synthetic oligonucleotide
gagaccgccagaagctcggaaaagcgat

SEQ ID NO: 574 - DNA, 21 bp, Artificial Sequence
  Description of Artificial Sequence: Synthetic oligonucleotide
ggatcgcttttccgagcttct

SEQ ID NO: 575 - DNA, 27 bp, Artificial Sequence
  Description of Artificial Sequence: Synthetic oligonucleotide
ggatcgcttttccgagcttctggcggt

SEQ ID NO: 576 - DNA, 22 bp, Artificial Sequence
  Description of Artificial Sequence: Synthetic oligonucleotide
gcgcccactgcaaggcccggcg

SEQ ID NO: 577 - DNA, 28 bp, Artificial Sequence
  Description of Artificial Sequence: Synthetic oligonucleotide
gcgcccactgcaaggcccggcgcacggt

SEQ ID NO: 578 - DNA, 21 bp, Artificial Sequence
  Description of Artificial Sequence: Synthetic oligonucleotide
gtagggccttcgcgcacctca

SEQ ID NO: 579 - DNA, 27 bp, Artificial Sequence
  Description of Artificial Sequence: Synthetic oligonucleotide
gtagggccttcgcgcacctcatggaat

SEQ ID NO: 580 - DNA, 22 bp, Artificial Sequence
  Description of Artificial Sequence: Synthetic oligonucleotide
gcagccgccgctccagagccgt

SEQ ID NO: 581 - DNA, 28 bp, Artificial Sequence
  Description of Artificial Sequence: Synthetic oligonucleotide
gcagccgccgctccagagccgtgcgaat

SEQ ID NO: 582 - DNA, 22 bp, Artificial Sequence
  Description of Artificial Sequence: Synthetic oligonucleotide
ggccatgccgaccaaagcgccg

SEQ ID NO: 583 - DNA, 28 bp, Artificial Sequence
  Description of Artificial Sequence: Synthetic oligonucleotide
ggccatgccgaccaaagcgccgatggat

SEQ ID NO: 584 - DNA, 21 bp, Artificial Sequence
  Description of Artificial Sequence: Synthetic oligonucleotide
gcaaggcccggcgcacggtgg

SEQ ID NO: 585 - DNA, 27 bp, Artificial Sequence
  Description of Artificial Sequence: Synthetic oligonucleotide
gcaaggcccggcgcacggtggcggggt

SEQ ID NO: 586 - DNA, 22 bp, Artificial Sequence
  Description of Artificial Sequence: Synthetic oligonucleotide
gaggcaagagggcggctttggg

SEQ ID NO: 587 - DNA, 28 bp, Artificial Sequence
  Description of Artificial Sequence: Synthetic oligonucleotide
gaggcaagagggcggctttgggcggggt

SEQ ID NO: 588 - DNA, 22 bp, Artificial Sequence
  Description of Artificial Sequence: Synthetic oligonucleotide
gtgaccgagggcctggaagttc

SEQ ID NO: 589 - DNA, 28 bp, Artificial Sequence
  Description of Artificial Sequence: Synthetic oligonucleotide
gtgaccgagggcctggaagttcgctaat

SEQ ID NO: 590 - DNA, 21 bp, Artificial Sequence
  Description of Artificial Sequence: Synthetic oligonucleotide
ggggtcccaggtgctgacgta

SEQ ID NO: 591 - DNA, 27 bp, Artificial Sequence
  Description of Artificial Sequence: Synthetic oligonucleotide
ggggtcccaggtgctgacgtaggtagt

SEQ ID NO: 592 - DNA, 22 bp, Artificial Sequence
  Description of Artificial Sequence: Synthetic oligonucleotide
gtactgattggaacatccgcga

SEQ ID NO: 593 - DNA, 28 bp, Artificial Sequence
  Description of Artificial Sequence: Synthetic oligonucleotide
gtactgattggaacatccgcgaaatgat

SEQ ID NO: 594 - DNA, 23 bp, Artificial Sequence
  Description of Artificial Sequence: Synthetic oligonucleotide
gtctgaagccatcgcttcctcct

SEQ ID NO: 595 - DNA, 29 bp, Artificial Sequence
  Description of Artificial Sequence: Synthetic oligonucleotide
gtctgaagccatcgcttcctcctgaaaat

SEQ ID NO: 596 - DNA, 21 bp, Artificial Sequence
  Description of Artificial Sequence: Synthetic oligonucleotide
ggttttcgctccgaaggtaaa

SEQ ID NO: 597 - DNA, 27 bp, Artificial Sequence
  Description of Artificial Sequence: Synthetic oligonucleotide
ggttttcgctccgaaggtaaaagaaat

SEQ ID NO: 598 - DNA, 21 bp, Artificial Sequence
  Description of Artificial Sequence: Synthetic oligonucleotide
gggactccccaagccctatta

SEQ ID NO: 599 - DNA, 27 bp, Artificial Sequence
  Description of Artificial Sequence: Synthetic oligonucleotide
gggactccccaagccctattaaaaaat

SEQ ID NO: 600 - DNA, 22 bp, Artificial Sequence
  Description of Artificial Sequence: Synthetic oligonucleotide
gcagcttgtttcacctcggtgc

SEQ ID NO: 601 - DNA, 28 bp, Artificial Sequence
  Description of Artificial Sequence: Synthetic oligonucleotide
gcagcttgtttcacctcggtgcagagat

SEQ ID NO: 602 - DNA, 22 bp, Artificial Sequence
  Description of Artificial Sequence: Synthetic oligonucleotide
gacctgtcttggttttcgctcc

SEQ ID NO: 603 - DNA, 28 bp, Artificial Sequence
  Description of Artificial Sequence: Synthetic oligonucleotide
gacctgtcttggttttcgctccgaaggt

SEQ ID NO: 604 - DNA, 23 bp, Artificial Sequence
  Description of Artificial Sequence: Synthetic oligonucleotide
gcttccatctgattagtaagtaa

SEQ ID NO: 605 - DNA, 29 bp, Artificial Sequence
  Description of Artificial Sequence: Synthetic oligonucleotide
gcttccatctgattagtaagtaatccaat

SEQ ID NO: 606 - DNA, 22 bp, Artificial Sequence
  Description of Artificial Sequence: Synthetic oligonucleotide
gtgcagagatgcctcggtgcct

SEQ ID NO: 607 - DNA, 28 bp, Artificial Sequence
  Description of Artificial Sequence: Synthetic oligonucleotide
gtgcagagatgcctcggtgcctgccagt

SEQ ID NO: 608 - DNA, 21 bp, Artificial Sequence
  Description of Artificial Sequence: Synthetic oligonucleotide
gagggtgcattttcaggagga

SEQ ID NO: 609 - DNA, 27 bp, Artificial Sequence
  Description of Artificial Sequence: Synthetic oligonucleotide
gagggtgcattttcaggaggaagcgat

SEQ ID NO: 610 - DNA, 23 bp, Artificial Sequence
  Description of Artificial Sequence: Synthetic oligonucleotide
gtttcacctcggtgcagagatgc

SEQ ID NO: 611 - DNA, 29 bp, Artificial Sequence
  Description of Artificial Sequence: Synthetic oligonucleotide
gtttcacctcggtgcagagatgcctcggt

SEQ ID NO: 612 - DNA, 22 bp, Artificial Sequence
  Description of Artificial Sequence: Synthetic oligonucleotide
gcgatggcttcagacagcatat

SEQ ID NO: 613 - DNA, 28 bp, Artificial Sequence
  Description of Artificial Sequence: Synthetic oligonucleotide
gcgatggcttcagacagcatatttgagt

SEQ ID NO: 614 - DNA, 22 bp, Artificial Sequence
  Description of Artificial Sequence: Synthetic oligonucleotide
gctccgaaggtaaaagaaatca

SEQ ID NO: 615 - DNA, 28 bp, Artificial Sequence
  Description of Artificial Sequence: Synthetic oligonucleotide
gctccgaaggtaaaagaaatcattgagt

SEQ ID NO: 616 - DNA, 22 bp, Artificial Sequence
  Description of Artificial Sequence: Synthetic oligonucleotide
gaggcatatgattacaagtcta

SEQ ID NO: 617 - DNA, 28 bp, Artificial Sequence
  Description of Artificial Sequence: Synthetic oligonucleotide
gaggcatatgattacaagtctattggat

SEQ ID NO: 618 - DNA, 21 bp, Artificial Sequence
  Description of Artificial Sequence: Synthetic oligonucleotide
gaaagagagatgtagggctag

SEQ ID NO: 619 - DNA, 27 bp, Artificial Sequence
  Description of Artificial Sequence: Synthetic oligonucleotide
gaaagagagatgtagggctagaggggt

SEQ ID NO: 620 - DNA, 23 bp, Artificial Sequence
  Description of Artificial Sequence: Synthetic oligonucleotide
gtactcacctctcatgaagcact

SEQ ID NO: 621 - DNA, 29 bp, Artificial Sequence
  Description of Artificial Sequence: Synthetic oligonucleotide
gtactcacctctcatgaagcactgtgggt

SEQ ID NO: 622 - DNA, 21 bp, Artificial Sequence
  Description of Artificial Sequence: Synthetic oligonucleotide
gaggtgagtacatgctggtct

SEQ ID NO: 623 - DNA, 27 bp, Artificial Sequence
  Description of Artificial Sequence: Synthetic oligonucleotide
gaggtgagtacatgctggtcttgtaat

SEQ ID NO: 624 - DNA, 22 bp, Artificial Sequence
  Description of Artificial Sequence: Synthetic oligonucleotide
gagaggaattcaaactgaggca

SEQ ID NO: 625 - DNA, 28 bp, Artificial Sequence
  Description of Artificial Sequence: Synthetic oligonucleotide
gagaggaattcaaactgaggcatatgat

SEQ ID NO: 626 - DNA, 21 bp, Artificial Sequence
  Description of Artificial Sequence: Synthetic oligonucleotide
gaggctgaaacagtgacctgt

SEQ ID NO: 627 - DNA, 27 bp, Artificial Sequence
  Description of Artificial Sequence: Synthetic oligonucleotide
gaggctgaaacagtgacctgtcttggt

SEQ ID NO: 628 - DNA, 21 bp, Artificial Sequence
  Description of Artificial Sequence: Synthetic oligonucleotide
gtacatgaagcaactccagtc

SEQ ID NO: 629 - DNA, 27 bp, Artificial Sequence
  Description of Artificial Sequence: Synthetic oligonucleotide
gtacatgaagcaactccagtcccaaat

SEQ ID NO: 630 - DNA, 21 bp, Artificial Sequence
  Description of Artificial Sequence: Synthetic oligonucleotide
gacgggtggggagagggacac

SEQ ID NO: 631 - DNA, 27 bp, Artificial Sequence
  Description of Artificial Sequence: Synthetic oligonucleotide
gacgggtggggagagggacacacagat

SEQ ID NO: 632 - DNA, 22 bp, Artificial Sequence
  Description of Artificial Sequence: Synthetic oligonucleotide
gtcccaaatatgtagctgtttg

SEQ ID NO: 633 - DNA, 28 bp, Artificial Sequence
  Description of Artificial Sequence: Synthetic oligonucleotide
gtcccaaatatgtagctgtttgggaggt

SEQ ID NO: 634 - DNA, 21 bp, Artificial Sequence
  Description of Artificial Sequence: Synthetic oligonucleotide
ggccaggggtcactccaggat

SEQ ID NO: 635 - DNA, 27 bp, Artificial Sequence
  Description of Artificial Sequence: Synthetic oligonucleotide
ggccaggggtcactccaggattccaat

SEQ ID NO: 636 - DNA, 22 bp, Artificial Sequence
  Description of Artificial Sequence: Synthetic oligonucleotide
gccagagccggggtgtgcagac

SEQ ID NO: 637 - DNA, 28 bp, Artificial Sequence
  Description of Artificial Sequence: Synthetic oligonucleotide
gccagagccggggtgtgcagacggcagt

SEQ ID NO: 638 - DNA, 22 bp, Artificial Sequence
  Description of Artificial Sequence: Synthetic oligonucleotide
gaggacgtgtgtgtctgtgtgg

SEQ ID NO: 639 - DNA, 28 bp, Artificial Sequence
  Description of Artificial Sequence: Synthetic oligonucleotide
gaggacgtgtgtgtctgtgtgggtgagt

SEQ ID NO: 640 - DNA, 22 bp, Artificial Sequence
  Description of Artificial Sequence: Synthetic oligonucleotide
gggagaaggccaggggtcactc

SEQ ID NO: 641 - DNA, 28 bp, Artificial Sequence
  Description of Artificial Sequence: Synthetic oligonucleotide
gggagaaggccaggggtcactccaggat

SEQ ID NO: 642 - DNA, 21 bp, Artificial Sequence
  Description of Artificial Sequence: Synthetic oligonucleotide
gggtgagtgagtgtgtgcgtg

SEQ ID NO: 643 - DNA, 27 bp, Artificial Sequence
  Description of Artificial Sequence: Synthetic oligonucleotide
gggtgagtgagtgtgtgcgtgtggggt

SEQ ID NO: 644 - DNA, 22 bp, Artificial Sequence
  Description of Artificial Sequence: Synthetic oligonucleotide
gagtgaggacgtgtgtgtctgt

SEQ ID NO: 645 - DNA, 28 bp, Artificial Sequence
  Description of Artificial Sequence: Synthetic oligonucleotide
gagtgaggacgtgtgtgtctgtgtgggt

SEQ ID NO: 646 - DNA, 22 bp, Artificial Sequence
  Description of Artificial Sequence: Synthetic oligonucleotide
gcgttggagcggggagaaggcc

SEQ ID NO: 647 - DNA, 28 bp, Artificial Sequence
  Description of Artificial Sequence: Synthetic oligonucleotide
gcgttggagcggggagaaggccaggggt

SEQ ID NO: 648 - DNA, 21 bp, Artificial Sequence
  Description of Artificial Sequence: Synthetic oligonucleotide
gctccattcacccagcttccc

SEQ ID NO: 649 - DNA, 27 bp, Artificial Sequence
  Description of Artificial Sequence: Synthetic oligonucleotide
gctccattcacccagcttccctgtggt

SEQ ID NO: 650 - DNA, 21 bp, Artificial Sequence
  Description of Artificial Sequence: Synthetic oligonucleotide
cccaagaagaagaggaaagtc

SEQ ID NO: 651 - DNA, 76 bp, Artificial Sequence
  Description of Artificial Sequence: Synthetic oligonucleotide
gttttagagctagaaatagcaagttaaaataaggctagtccgttatcaacttgaaaaagtggcaccgagtcggtgc

SEQ ID NO: 652 - DNA, 20 bp, Artificial Sequence
  Description of Artificial Sequence: Synthetic oligonucleotide
tccagatggcacattgtcag

SEQ ID NO: 653 - DNA, 20 bp, Artificial Sequence
  Description of Artificial Sequence: Synthetic oligonucleotide
agggagcaggaaagtgaggt

SEQ ID NO: 654 - DNA, 21 bp, Artificial Sequence
  Description of Artificial Sequence: Synthetic oligonucleotide
gtagttgccgtcgtccttgaa

SEQ ID NO: 655 - DNA, 27 bp, Artificial Sequence
  Description of Artificial Sequence: Synthetic oligonucleotide
gtagttgccgtcgtccttgaagaagat

SEQ ID NO: 656 - DNA, 22 bp, Artificial Sequence
  Description of Artificial Sequence: Synthetic oligonucleotide
gccacctacggcaagctgaccc

SEQ ID NO: 657 - DNA, 28 bp, Artificial Sequence
  Description of Artificial Sequence: Synthetic oligonucleotide
gccacctacggcaagctgaccctgaagt

SEQ ID NO: 658 - DNA, 23 bp, Artificial Sequence
  Description of Artificial Sequence: Synthetic oligonucleotide
gacggcaactacaagacccgcgc

SEQ ID NO: 659 - DNA, 29 bp, Artificial Sequence
  Description of Artificial Sequence: Synthetic oligonucleotide
gacggcaactacaagacccgcgccgaggt

SEQ ID NO: 660 - DNA, 23 bp, Artificial Sequence
  Description of Artificial Sequence: Synthetic oligonucleotide
gagtccgagcagaagaagaaggg

SEQ ID NO: 661 - DNA, 23 bp, Artificial Sequence
  Description of Artificial Sequence: Synthetic oligonucleotide
gagttagagcagaagaagaaagg

SEQ ID NO: 662 - DNA, 23 bp, Artificial Sequence
  Description of Artificial Sequence: Synthetic oligonucleotide
gagtctaagcagaagaagaagag

SEQ ID NO: 663 - DNA, 23 bp, Artificial Sequence
  Description of Artificial Sequence: Synthetic oligonucleotide
gaggccgagcagaagaaagacgg

SEQ ID NO: 664 - DNA, 23 bp, Artificial Sequence
  Description of Artificial Sequence: Synthetic oligonucleotide
gagtcctagcaggagaagaagag

SEQ ID NO: 665 - DNA, 23 bp, Artificial Sequence
  Description of Artificial Sequence: Synthetic oligonucleotide
aagtctgagcacaagaagaatgg

SEQ ID NO: 666 - DNA, 23 bp, Artificial Sequence
  Description of Artificial Sequence: Synthetic oligonucleotide
gagtccgggaaggagaagaaagg

SEQ ID NO: 667 - DNA, 23 bp, Artificial Sequence
  Description of Artificial Sequence: Synthetic oligonucleotide
gaatccaagcaggagaagaagga

SEQ ID NO: 668 - DNA, 23 bp, Artificial Sequence
  Description of Artificial Sequence: Synthetic oligonucleotide
acgtctgagcagaagaagaatgg

SEQ ID NO: 669 - DNA, 23 bp, Artificial Sequence
  Description of Artificial Sequence: Synthetic oligonucleotide
ggtgagtgagtgtgtgcgtgtgg

SEQ ID NO: 670 - DNA, 23 bp, Artificial Sequence
  Description of Artificial Sequence: Synthetic oligonucleotide
agtgagtgagtgtgtgtgtgggg

SEQ ID NO: 671 - DNA, 23 bp, Artificial Sequence
  Description of Artificial Sequence: Synthetic oligonucleotide
agagagtgagtgtgtgcatgagg

SEQ ID NO: 672 - DNA, 23 bp, Artificial Sequence
  Description of Artificial Sequence: Synthetic oligonucleotide
tgtgggtgagtgtgtgcgtgagg

SEQ ID NO: 673 - DNA, 23 bp, Artificial Sequence
  Description of Artificial Sequence: Synthetic oligonucleotide
gctgagtgagtgtatgcgtgtgg

SEQ ID NO: 674 - DNA, 23 bp, Artificial Sequence
  Description of Artificial Sequence: Synthetic oligonucleotide
tgtgggtgagtgtgtgcgtgaga

SEQ ID NO: 675 - DNA, 23 bp, Artificial Sequence
  Description of Artificial Sequence: Synthetic oligonucleotide
tgtgagtgagtgtgtgcgtgtga

SEQ ID NO: 676 - DNA, 23 bp, Artificial Sequence
  Description of Artificial Sequence: Synthetic oligonucleotide
ggtgagtgagtgcgtgcgggtgg

SEQ ID NO: 677 - DNA, 23 bp, Artificial Sequence
  Description of Artificial Sequence: Synthetic oligonucleotide
agtgtgtgagtgtgtgcgtgtgg

SEQ ID NO: 678 - DNA, 23 bp, Artificial Sequence
  Description of Artificial Sequence: Synthetic oligonucleotide
actgtgtgagtgtgtgcgtgagg

SEQ ID NO: 679 - DNA, 23 bp, Artificial Sequence
  Description of Artificial Sequence: Synthetic oligonucleotide
gaccccctccaccccgcctccgg

SEQ ID NO: 680 - DNA, 23 bp, Artificial Sequence
  Description of Artificial Sequence: Synthetic oligonucleotide
attcccccccaccccgcctcagg

SEQ ID NO: 681 - DNA, 23 bp, Artificial Sequence
  Description of Artificial Sequence: Synthetic oligonucleotide
acacccccccaccccgcctcagg

SEQ ID NO: 682 - DNA, 23 bp, Artificial Sequence
  Description of Artificial Sequence: Synthetic oligonucleotide
gggcccctccaccccgcctctgg

SEQ ID NO: 683 - DNA, 23 bp, Artificial Sequence
  Description of Artificial Sequence: Synthetic oligonucleotide
cgccctccccaccccgcctccgg

SEQ ID NO: 684 - DNA, 23 bp, Artificial Sequence
  Description of Artificial Sequence: Synthetic oligonucleotide
gaccccccccaccccgcccccgg

SEQ ID NO: 685 - DNA, 23 bp, Artificial Sequence
  Description of Artificial Sequence: Synthetic oligonucleotide
gcccccacccaccccgcctctgg

SEQ ID NO: 686 - DNA, 23 bp, Artificial Sequence
  Description of Artificial Sequence: Synthetic oligonucleotide
ctccccacccaccccgcctcagg

SEQ ID NO: 687 - DNA, 23 bp, Artificial Sequence
  Description of Artificial Sequence: Synthetic oligonucleotide
tgcccctcccaccccgcctctgg

SEQ ID NO: 688 - DNA, 23 bp, Artificial Sequence
  Description of Artificial Sequence: Synthetic oligonucleotide
gggcacgggcagcttgcccgtga

SEQ ID NO: 689 - DNA, 26 bp, Artificial Sequence
  Description of Artificial Sequence: Synthetic oligonucleotide
  modified_base (21)..(26): a, c, t, g, unknown or other
gggcacgggcagcttgcccgnnnnnn

SEQ ID NO: 690 - DNA, 26 bp, Artificial Sequence
  Description of Artificial Sequence: Synthetic oligonucleotide
  modified_base (21)..(26): a, c, t, g, unknown or other
gtcgccctcgaacttcacctnnnnnn

SEQ ID NO: 691 - DNA, 24 bp, Artificial Sequence
  Description of Artificial Sequence: Synthetic oligonucleotide
gccacgaagcaggccaatggggag

SEQ ID NO: 692 - DNA, 24 bp, Artificial Sequence
  Description of Artificial Sequence: Synthetic oligonucleotide
gccacacagcaggtcaatggggaa

SEQ ID NO: 693 - DNA, 24 bp, Artificial Sequence
  Description of Artificial Sequence: Synthetic oligonucleotide
gaatcccttctgcagcacctggat

SEQ ID NO: 694 - DNA, 24 bp, Artificial Sequence
  Description of Artificial Sequence: Synthetic oligonucleotide
caatacctactgcagcacctagag

SEQ ID NO: 695 - DNA, 24 bp, Artificial Sequence
  Description of Artificial Sequence: Synthetic oligonucleotide
ctgtcccctccacagcacctggag

SEQ ID NO: 696 - DNA, 24 bp, Artificial Sequence
  Description of Artificial Sequence: Synthetic oligonucleotide
aaatcccttccgcagcacctaggt

SEQ ID NO: 697 - DNA, 24 bp, Artificial Sequence
  Description of Artificial Sequence: Synthetic oligonucleotide
taatcccttccacagtacctagaa

SEQ ID NO: 698 - DNA, 24 bp, Artificial Sequence
  Description of Artificial Sequence: Synthetic oligonucleotide
gaaccccttctacagcacctcggc

SEQ ID NO: 699 - DNA, 24 bp, Artificial Sequence
  Description of Artificial Sequence: Synthetic oligonucleotide
ttatcccttctccagcacctagaa

SEQ ID NO: 700 - DNA, 24 bp, Artificial Sequence
  Description of Artificial Sequence: Synthetic oligonucleotide
gcggcggctgcacaaccagtggag

SEQ ID NO: 701 - DNA, 25 bp, Artificial Sequence
  Description of Artificial Sequence: Synthetic oligonucleotide
tatgcggctgcacagccagtgggag

SEQ ID NO: 702 - DNA, 24 bp, Artificial Sequence
  Description of Artificial Sequence: Synthetic oligonucleotide
gtgggggccacacaaccagttgag

SEQ ID NO: 703 - DNA, 24 bp, Artificial Sequence
  Description of Artificial Sequence: Synthetic oligonucleotide
ggttgtgcagccgccgctccagag

SEQ ID NO: 704 - DNA, 24 bp, Artificial Sequence
  Description of Artificial Sequence: Synthetic oligonucleotide
ggtgcattttcaggaggaagcgat

SEQ ID NO: 705 - DNA, 24 bp, Artificial Sequence
  Description of Artificial Sequence: Synthetic oligonucleotide
ggtccattttcaggaggaagagtg

SEQ ID NO: 706 - DNA, 24 bp, Artificial Sequence
  Description of Artificial Sequence: Synthetic oligonucleotide
actgcattttcaggaggaacagag

SEQ ID NO: 707 - DNA, 25 bp, Artificial Sequence
  Description of Artificial Sequence: Synthetic oligonucleotide
gatgcatttccaggaggaaggagag

SEQ ID NO: 708 - DNA, 24 bp, Artificial Sequence
  Description of Artificial Sequence: Synthetic oligonucleotide
aatgcattttcagaaggaagtgat

SEQ ID NO: 709 - DNA, 24 bp, Artificial Sequence
  Description of Artificial Sequence: Synthetic oligonucleotide
agtgcatcatcaggaggaagggaa

SEQ ID NO: 710 - DNA, 24 bp, Artificial Sequence
  Description of Artificial Sequence: Synthetic oligonucleotide
gacgcatcttcaagaggaagtgaa

SEQ ID NO: 711 - DNA, 24 bp, Artificial Sequence
  Description of Artificial Sequence: Synthetic oligonucleotide
gctgcatgtccaggaggaagggag

SEQ ID NO: 712 - DNA, 24 bp, Artificial Sequence
  Description of Artificial Sequence: Synthetic oligonucleotide
ggtccatgttcaggaggaaaggag

SEQ ID NO: 713 - DNA, 24 bp, Artificial Sequence
  Description of Artificial Sequence: Synthetic oligonucleotide
ggtccatttccaggagaaagggag

SEQ ID NO: 714 - DNA, 24 bp, Artificial Sequence
  Description of Artificial Sequence: Synthetic oligonucleotide
ggtgcactcacaggaggaaatgag

SEQ ID NO: 715 - DNA, 24 bp, Artificial Sequence
  Description of Artificial Sequence: Synthetic oligonucleotide
gtgatatagggctagaggagagaa

SEQ ID NO: 716 - DNA, 24 bp, Artificial Sequence
  Description of Artificial Sequence: Synthetic oligonucleotide
gagctgcagggctagagggaggag

SEQ ID NO: 717 - DNA, 24 bp, Artificial Sequence
  Description of Artificial Sequence: Synthetic oligonucleotide
gagatgtagggctagaggggtgag

SEQ ID NO: 718 - DNA, 25 bp, Artificial Sequence
  Description of Artificial Sequence: Synthetic oligonucleotide
gagatgtagggagagagggagagag

SEQ ID NO: 719 - DNA, 24 bp, Artificial Sequence
  Description of Artificial Sequence: Synthetic oligonucleotide
tgagagtagggctagaggagggag

SEQ ID NO: 720 - DNA, 24 bp, Artificial Sequence
  Description of Artificial Sequence: Synthetic oligonucleotide
gagatgttgggccagaggggagaa

SEQ ID NO: 721 - DNA, 24 bp, Artificial Sequence
  Description of Artificial Sequence: Synthetic oligonucleotide
gagatgaaaggcaagaggggagag

SEQ ID NO: 722 - DNA, 24 bp, Artificial Sequence
  Description of Artificial Sequence: Synthetic oligonucleotide
agagtgtaggaccagaggggtggg

SEQ ID NO: 723 - DNA, 24 bp, Artificial Sequence
  Description of Artificial Sequence: Synthetic oligonucleotide
ttagtgtagggccagagagggaag

SEQ ID NO: 724 - DNA, 24 bp, Artificial Sequence
  Description of Artificial Sequence: Synthetic oligonucleotide
gagatggagggcaagaggggagaa

SEQ ID NO: 725 - DNA, 24 bp, Artificial Sequence
  Description of Artificial Sequence: Synthetic oligonucleotide
gaaatgtaggtctagagaggggac

SEQ ID NO: 726 - DNA, 24 bp, Artificial Sequence
  Description of Artificial Sequence: Synthetic oligonucleotide
aagatgtatgactagagggaggga

SEQ ID NO: 727 - DNA, 24 bp, Artificial Sequence
  Description of Artificial Sequence: Synthetic oligonucleotide
gagctgtagggccaaagggaggag

SEQ ID NO: 728 - DNA, 24 bp, Artificial Sequence
  Description of Artificial Sequence: Synthetic oligonucleotide
gagatatagggcaagaggaaggag

SEQ ID NO: 729 - DNA, 24 bp, Artificial Sequence
  Description of Artificial Sequence: Synthetic oligonucleotide
aaagtgcaggactaaaggggtgag

SEQ ID NO: 730 - DNA, 24 bp, Artificial Sequence
  Description of Artificial Sequence: Synthetic oligonucleotide
ctgatgtggggctggaggggtgag

SEQ ID NO: 731 - DNA, 24 bp, Artificial Sequence
  Description of Artificial Sequence: Synthetic oligonucleotide
aagtggtaggattagaggggtgag

SEQ ID NO: 732 - DNA, 24 bp, Artificial Sequence
  Description of Artificial Sequence: Synthetic oligonucleotide
actgtgtaggcctagagaggtgag

SEQ ID NO: 733 - DNA, 24 bp, Artificial Sequence
  Description of Artificial Sequence: Synthetic oligonucleotide
gagatgtagttctagagggagagg

SEQ ID NO: 734 - DNA, 24 bp, Artificial Sequence
  Description of Artificial Sequence: Synthetic oligonucleotide
gtgatgtagaactagaggggtggg

SEQ ID NO: 735 - DNA, 24 bp, Artificial Sequence
  Description of Artificial Sequence: Synthetic oligonucleotide
gagttggaggcctagagaggggag

SEQ ID NO: 736 - DNA, 24 bp, Artificial Sequence
  Description of Artificial Sequence: Synthetic oligonucleotide
gatgagtagggctagaagggggag

SEQ ID NO: 737 - DNA, 24 bp, Artificial Sequence
  Description of Artificial Sequence: Synthetic oligonucleotide
aagatgaaggaatagaggggaaag

SEQ ID NO: 738 - DNA, 24 bp, Artificial Sequence
  Description of Artificial Sequence: Synthetic oligonucleotide
gggatggggggctagaggagggag

SEQ ID NO: 739 - DNA, 24 bp, Artificial Sequence
  Description of Artificial Sequence: Synthetic oligonucleotide
gtggtatagggctagaggggagat

SEQ ID NO: 740 - DNA, 24 bp, Artificial Sequence
  Description of Artificial Sequence: Synthetic oligonucleotide
gaggtgcggggcaaggggagggag

SEQ ID NO: 741 - DNA, 24 bp, Artificial Sequence
  Description of Artificial Sequence: Synthetic oligonucleotide
gatatgtagggccaaagggaagag

SEQ ID NO: 742 - DNA, 24 bp, Artificial Sequence
  Description of Artificial Sequence: Synthetic oligonucleotide
gtgatgtggggctagagagtagaa

SEQ ID NO: 743 - DNA, 24 bp, Artificial Sequence
  Description of Artificial Sequence: Synthetic oligonucleotide
ggaatgtagggccagagagaggag

SEQ ID NO: 744 - DNA, 24 bp, Artificial Sequence
  Description of Artificial Sequence: Synthetic oligonucleotide
atgatgtaggtcaagaggggtgaa

SEQ ID NO: 745 - DNA, 24 bp, Artificial Sequence
  Description of Artificial Sequence: Synthetic oligonucleotide
tggatgtaggagtagagggtagag

SEQ ID NO: 746 - DNA, 24 bp, Artificial Sequence
  Description of Artificial Sequence: Synthetic oligonucleotide
gagaagcagggctagaggaggagg

SEQ ID NO: 747 - DNA, 24 bp, Artificial Sequence
  Description of Artificial Sequence: Synthetic oligonucleotide
aagatgaagggctaggggtgagag

SEQ ID NO: 748 - DNA, 24 bp, Artificial Sequence
  Description of Artificial Sequence: Synthetic oligonucleotide
gagatataaggctggaggggtaag

SEQ ID NO: 749 - DNA, 24 bp, Artificial Sequence
  Description of Artificial Sequence: Synthetic oligonucleotide
aagatacagggagagaggggagag

SEQ ID NO: 750 - DNA, 24 bp, Artificial Sequence
  Description of Artificial Sequence: Synthetic oligonucleotide
gaggactagggctagagggagggt

SEQ ID NO: 751 - DNA, 24 bp, Artificial Sequence
  Description of Artificial Sequence: Synthetic oligonucleotide
cagatgtagggctggggggagagg

SEQ ID NO: 752 - DNA, 24 bp, Artificial Sequence
  Description of Artificial Sequence: Synthetic oligonucleotide
cagatgtagggctaaaatggggag

SEQ ID NO: 753 - DNA, 24 bp, Artificial Sequence
  Description of Artificial Sequence: Synthetic oligonucleotide
agtatataggtctagaggggagag

SEQ ID NO: 754 - DNA, 24 bp, Artificial Sequence
  Description of Artificial Sequence: Synthetic oligonucleotide
aatatgtagggaaagaggggggaa

SEQ ID NO: 755 - DNA, 24 bp, Artificial Sequence
  Description of Artificial Sequence: Synthetic oligonucleotide
gagaggtagggatagaggggagta

SEQ ID NO: 756 - DNA, 24 bp, Artificial Sequence
  Description of Artificial Sequence: Synthetic oligonucleotide
gaggagtaggggtagaggggtgat

SEQ ID NO: 757 - DNA, 24 bp, Artificial Sequence
  Description of Artificial Sequence: Synthetic oligonucleotide
aagatgcagagcaagaggggggaa

SEQ ID NO: 758 - DNA, 24 bp, Artificial Sequence
  Description of Artificial Sequence: Synthetic oligonucleotide
aagatgcaggggtagaggggtggg

SEQ ID NO: 759 - DNA, 24 bp, Artificial Sequence
  Description of Artificial Sequence: Synthetic oligonucleotide
aagctgtagggccagatgggagag

SEQ ID NO: 760 - DNA, 24 bp, Artificial Sequence
  Description of Artificial Sequence: Synthetic oligonucleotide
gagctgcagggctaggggggtgag

SEQ ID NO: 761 - DNA, 25 bp, Artificial Sequence
  Description of Artificial Sequence: Synthetic oligonucleotide
gagatgtaggaccagagggagggac

SEQ ID NO: 762 - DNA, 24 bp, Artificial Sequence
  Description of Artificial Sequence: Synthetic oligonucleotide
aagatgtcaggccagaggggtaag

SEQ ID NO: 763 - DNA, 24 bp, Artificial Sequence
  Description of Artificial Sequence: Synthetic oligonucleotide
gagatgttgggccagaggggagaa

SEQ ID NO: 764 - DNA, 24 bp, Artificial Sequence
  Description of Artificial Sequence: Synthetic oligonucleotide
gggttgcagggccagagggggagg

SEQ ID NO: 765 - DNA, 24 bp, Artificial Sequence
  Description of Artificial Sequence: Synthetic oligonucleotide
gagatgttgggatagagggggaaa

SEQ ID NO: 766 - DNA, 24 bp, Artificial Sequence
  Description of Artificial Sequence: Synthetic oligonucleotide
gaggggtaggactagagggggaaa

SEQ ID NO: 767 - DNA, 24 bp, Artificial Sequence
  Description of Artificial Sequence: Synthetic oligonucleotide
gggatgtagggctagggggaagac

SEQ ID NO: 768 - DNA, 24 bp, Artificial Sequence
  Description of Artificial Sequence: Synthetic oligonucleotide
gagatgaagtactagaagggagag

SEQ ID NO: 769 - DNA, 25 bp, Artificial Sequence
  Description of Artificial Sequence: Synthetic oligonucleotide
cagatgtaggattagagggagagaa

SEQ ID NO: 770 - DNA, 24 bp, Artificial Sequence
  Description of Artificial Sequence: Synthetic oligonucleotide
gaggtgtggggctggagggggaag

SEQ ID NO: 771 - DNA, 24 bp, Artificial Sequence
  Description of Artificial Sequence: Synthetic oligonucleotide
gagaggtagggctggaggggagct

SEQ ID NO: 772 - DNA, 24 bp, Artificial Sequence
  Description of Artificial Sequence: Synthetic oligonucleotide
gcgagcagcgtcttcgagagtgag

SEQ ID NO: 773 - DNA, 24 bp, Artificial Sequence
  Description of Artificial Sequence: Synthetic oligonucleotide
ctgtggcaagagcttcagccagag

SEQ ID NO: 774 - DNA, 24 bp, Artificial Sequence
  Description of Artificial Sequence: Synthetic oligonucleotide
gtgcggcaagagcttcagccagag

SEQ ID NO: 775 - DNA, 24 bp, Artificial Sequence
  Description of Artificial Sequence: Synthetic oligonucleotide
tcgcagcaagagcttcagcctgag

SEQ ID NO: 776 - DNA, 24 bp, Artificial Sequence
  Description of Artificial Sequence: Synthetic oligonucleotide
gtgcgggaagagcttcatccagag

SEQ ID NO: 777 - DNA, 24 bp, Artificial Sequence
  Description of Artificial Sequence: Synthetic oligonucleotide
gtgtggcaagagcttcagcaggag

SEQ ID NO: 778 - DNA, 24 bp, Artificial Sequence
  Description of Artificial Sequence: Synthetic oligonucleotide
gtgtgggaagagcttcagccagag

SEQ ID NO: 779 - DNA, 24 bp, Artificial Sequence
  Description of Artificial Sequence: Synthetic oligonucleotide
gtgcaacaagagctccagcctgag

SEQ ID NO: 780 - DNA, 24 bp, Artificial Sequence
  Description of Artificial Sequence: Synthetic oligonucleotide
gtgcggcaagagcttcagccgggg

SEQ ID NO: 781 - DNA, 24 bp, Artificial Sequence
  Description of Artificial Sequence: Synthetic oligonucleotide
atgtggtaagggcttcagccagag

SEQ ID NO: 782 - DNA, 24 bp, Artificial Sequence
  Description of Artificial Sequence: Synthetic oligonucleotide
atgtggtaagagcttcagccagat

SEQ ID NO: 783 - DNA, 24 bp, Artificial Sequence
  Description of Artificial Sequence: Synthetic oligonucleotide
gtgtggcaagaccttcagccagac

SEQ ID NO: 784 - DNA, 24 bp, Artificial Sequence
  Description of Artificial Sequence: Synthetic oligonucleotide
ctgcggcaagtgcttcagctggag

SEQ ID NO: 785 - DNA, 24 bp, Artificial Sequence
  Description of Artificial Sequence: Synthetic oligonucleotide
gtgcggcaagagcttcagccagaa

SEQ ID NO: 786 - DNA, 24 bp, Artificial Sequence
  Description of Artificial Sequence: Synthetic oligonucleotide
gtgtggcaagaccttcagccggac

SEQ ID NO: 787 - DNA, 24 bp, Artificial Sequence
  Description of Artificial Sequence: Synthetic oligonucleotide
gtgcggcaagagcttcagccagtg

SEQ ID NO: 788 - DNA, 24 bp, Artificial Sequence
  Description of Artificial Sequence: Synthetic oligonucleotide
gtgtggcaagagcttcagcaggaa

SEQ ID NO: 789 - DNA, 24 bp, Artificial Sequence
  Description of Artificial Sequence: Synthetic oligonucleotide
gtgcggcaagagcttcagccggcg

SEQ ID NO: 790 - DNA, 24 bp, Artificial Sequence
  Description of Artificial Sequence: Synthetic oligonucleotide
gagcagcaagaacttcagcccaag

SEQ ID NO: 791 - DNA, 24 bp, Artificial Sequence
  Description of Artificial Sequence: Synthetic oligonucleotide
gtgtggcaagggcttcagccaggc

SEQ ID NO: 792 - DNA, 24 bp, Artificial Sequence
  Description of Artificial Sequence: Synthetic oligonucleotide
gtgcggcaaggccttcagccagag

SEQ ID NO: 793 - DNA, 24 bp, Artificial Sequence
  Description of Artificial Sequence: Synthetic oligonucleotide
gtgcggcaagaccttcaccctgag

SEQ ID NO: 794 - DNA, 24 bp, Artificial Sequence
  Description of Artificial Sequence: Synthetic oligonucleotide
atgaggcaagaacataagcctgag

SEQ ID NO: 795 - DNA, 24 bp, Artificial Sequence
  Description of Artificial Sequence: Synthetic oligonucleotide
gcagaagggattccatgaggtgcg

SEQ ID NO: 796 - DNA, 24 bp, Artificial Sequence
  Description of Artificial Sequence: Synthetic oligonucleotide
tgagaagagatcccatgagggaag

SEQ ID NO: 797 - DNA, 23 bp, Artificial Sequence
  Description of Artificial Sequence: Synthetic oligonucleotide
gaagggattccatgaggtgcgcg

SEQ ID NO: 798 - DNA, 23 bp, Artificial Sequence
  Description of Artificial Sequence: Synthetic oligonucleotide
atagggattccatgaggtgtgga

SEQ ID NO: 799 - DNA, 23 bp, Artificial Sequence
  Description of Artificial Sequence: Synthetic oligonucleotide
gggtgcattttcaggaggaagcg

SEQ ID NO: 800 - DNA, 24 bp, Artificial Sequence
  Description of Artificial Sequence: Synthetic oligonucleotide
gcagacggcagtcactagggggcg

SEQ ID NO: 801 - DNA, 25 bp, Artificial Sequence
  Description of Artificial Sequence: Synthetic oligonucleotide
acagaaggcagccactagggaggcc

SEQ ID NO: 802 - DNA, 24 bp, Artificial Sequence
  Description of Artificial Sequence: Synthetic oligonucleotide
tcagacggtggtcactaggaggcg

SEQ ID NO: 803 - DNA, 24 bp, Artificial Sequence
  Description of Artificial Sequence: Synthetic oligonucleotide
gcagaaaacagccactagggtgcc

SEQ ID NO: 804 - DNA, 24 bp, Artificial Sequence
  Description of Artificial Sequence: Synthetic oligonucleotide
gcagacgacagtcactaggaagcc

SEQ ID NO: 805 - DNA, 24 bp, Artificial Sequence
  Description of Artificial Sequence: Synthetic oligonucleotide
gctgggtgaatggagcgagcagcg

SEQ ID NO: 806 - DNA, 23 bp, Artificial Sequence
  Description of Artificial Sequence: Synthetic oligonucleotide
gagttagagcagaagaagaaagg

SEQ ID NO: 807 - DNA, 23 bp, Artificial Sequence
  Description of Artificial Sequence: Synthetic oligonucleotide
gagtctaagcagaagaagaagag

SEQ ID NO: 808 - DNA, 23 bp, Artificial Sequence
  Description of Artificial Sequence: Synthetic oligonucleotide
gaggccgagcagaagaaagacgg

SEQ ID NO: 809 - DNA, 23 bp, Artificial Sequence
  Description of Artificial Sequence: Synthetic oligonucleotide
gagtcctagcaggagaagaagag

SEQ ID NO: 810 - DNA, 23 bp, Artificial Sequence
  Description of Artificial Sequence: Synthetic oligonucleotide
aagtctgagcacaagaagaatgg

SEQ ID NO: 811 - DNA, 23 bp, Artificial Sequence
  Description of Artificial Sequence: Synthetic oligonucleotide
gagtccgggaaggagaagaaagg

SEQ ID NO: 812 - DNA, 23 bp, Artificial Sequence
  Description of Artificial Sequence: Synthetic oligonucleotide
gaatccaagcaggagaagaagga

SEQ ID NO: 813 - DNA, 23 bp, Artificial Sequence
  Description of Artificial Sequence: Synthetic oligonucleotide
gtgtggcaagggcttcagccagg

SEQ ID NO: 814 - DNA, 23 bp, Artificial Sequence
  Description of Artificial Sequence: Synthetic oligonucleotide
gtgaggcaggagcatcagcccgg

SEQ ID NO: 815 - DNA, 23 bp, Artificial Sequence
  Description of Artificial Sequence: Synthetic oligonucleotide
atggggaaagagcttcagcctgg

SEQ ID NO: 816 - DNA, 23 bp, Artificial Sequence
  Description of Artificial Sequence: Synthetic oligonucleotide
gtgagggaagagcttcagcaagg

SEQ ID NO: 817 - DNA, 23 bp, Artificial Sequence
  Description of Artificial Sequence: Synthetic oligonucleotide
atgtggtaagagcttcagccaga

SEQ ID NO: 818 - DNA, 23 bp, Artificial Sequence
  Description of Artificial Sequence: Synthetic oligonucleotide
gtggggcaagaggttcagcctgg

SEQ ID NO: 819 - DNA, 23 bp, Artificial Sequence
  Description of Artificial Sequence: Synthetic oligonucleotide
gtgcggcaagagcttcagccaga

SEQ ID NO: 820 - DNA, 23 bp, Artificial Sequence
  Description of Artificial Sequence: Synthetic oligonucleotide
ctgtggcaagagcttcagccaga

SEQ ID NO: 821 - DNA, 23 bp, Artificial Sequence
  Description of Artificial Sequence: Synthetic oligonucleotide
tcgcagcaagagcttcagcctga

SEQ ID NO: 822 - DNA, 23 bp, Artificial Sequence
  Description of Artificial Sequence: Synthetic oligonucleotide
gtgctgcaggggcttcagcccgg

SEQ ID NO: 823 - DNA, 23 bp, Artificial Sequence
  Description of Artificial Sequence: Synthetic oligonucleotide
gtgtggcaagaccttcagccgga

SEQ ID NO: 824 - DNA, 23 bp, Artificial Sequence
  Description of Artificial Sequence: Synthetic oligonucleotide
gtgtggcaagagcttcagcagga

SEQ ID NO: 825 - DNA, 23 bp, Artificial Sequence
  Description of Artificial Sequence: Synthetic oligonucleotide
ttccggcaggagcttcagcctgg

SEQ ID NO: 826 - DNA, 23 bp, Artificial Sequence
  Description of Artificial Sequence: Synthetic oligonucleotide
gtgtgacaagagcttcaacaggg

SEQ ID NO: 827 - DNA, 23 bp, Artificial Sequence
  Description of Artificial Sequence: Synthetic oligonucleotide
gctgagtgagtgtatgcgtgtgg

SEQ ID NO: 828 - DNA, 23 bp, Artificial Sequence
  Description of Artificial Sequence: Synthetic oligonucleotide
tgtgggtgagtgtgtgcgtgagg

SEQ ID NO: 829 - DNA, 23 bp, Artificial Sequence
  Description of Artificial Sequence: Synthetic oligonucleotide
agtgagtgagtgtgtgtgtgggg

SEQ ID NO: 830 - DNA, 23 bp, Artificial Sequence
  Description of Artificial Sequence: Synthetic oligonucleotide
agagagtgagtgtgtgcatgagg

SEQ ID NO: 831 - DNA, 23 bp, Artificial Sequence
  Description of Artificial Sequence: Synthetic oligonucleotide
gttgagtgaatgtgtgcgtgagg

SEQ ID NO: 832 - DNA, 23 bp, Artificial Sequence
  Description of Artificial Sequence: Synthetic oligonucleotide
agtgaatgagtgtgtgtgtgtgg

SEQ ID NO: 833 - DNA, 23 bp, Artificial Sequence
  Description of Artificial Sequence: Synthetic oligonucleotide
ggtgagtgagtgcgtgcgggtgg

SEQ ID NO: 834 - DNA, 23 bp, Artificial Sequence
  Description of Artificial Sequence: Synthetic oligonucleotide
agcgagtgggtgtgtgcgtgggg

SEQ ID NO: 835 - DNA, 23 bp, Artificial Sequence
  Description of Artificial Sequence: Synthetic oligonucleotide
agtgtgtgagtgtgtgcgtgtgg

SEQ ID NO: 836 - DNA, 23 bp, Artificial Sequence
  Description of Artificial Sequence: Synthetic oligonucleotide
tgtgagtaagtgtgtgtgtgtgg

SEQ ID NO: 837 - DNA, 23 bp, Artificial Sequence
  Description of Artificial Sequence: Synthetic oligonucleotide
actgtgtgagtgtgtgcgtgagg

SEQ ID NO: 838 - DNA, 23 bp, Artificial Sequence
  Description of Artificial Sequence: Synthetic oligonucleotide
ggtgagtgagtgtgtgtgtgagg

SEQ ID NO: 839 - DNA, 23 bp, Artificial Sequence
  Description of Artificial Sequence: Synthetic oligonucleotide
tgtgggtgagtgtgtgcgtgaga

SEQ ID NO: 840 - DNA, 23 bp, Artificial Sequence
  Description of Artificial Sequence: Synthetic oligonucleotide
ggtggatgagtgtgtgtgtgggg

SEQ ID NO: 841 - DNA, 23 bp, Artificial Sequence
  Description of Artificial Sequence: Synthetic oligonucleotide
tgtgagtgagtgtgtgcgtgtga

SEQ ID NO: 842 - DNA, 23 bp, Artificial Sequence
  Description of Artificial Sequence: Synthetic oligonucleotide
agggagtgactgtgtgcgtgtgg

SEQ ID NO: 843 - DNA, 23 bp, Artificial Sequence
  Description of Artificial Sequence: Synthetic oligonucleotide
ggtgtgtgagtgtgtgtgtgtgg

SEQ ID NO: 844 - DNA, 23 bp, Artificial Sequence
  Description of Artificial Sequence: Synthetic oligonucleotide
agcgagtgagtgtgtgtgtgggg

SEQ ID NO: 845 - DNA, 23 bp, Artificial Sequence
  Description of Artificial Sequence: Synthetic oligonucleotide
tgtgggtgagcatgtgcgtgagg

SEQ ID NO: 846 - DNA, 23 bp, Artificial Sequence
  Description of Artificial Sequence: Synthetic oligonucleotide
tgtgagtgagtgtgtgtatgggg

SEQ ID NO: 847 - DNA, 23 bp, Artificial Sequence
  Description of Artificial Sequence: Synthetic oligonucleotide
agtgagaaagtgtgtgcatgcgg

SEQ ID NO: 848 - DNA, 23 bp, Artificial Sequence
  Description of Artificial Sequence: Synthetic oligonucleotide
ggtgagtaagtgtgagcgtaagg

SEQ ID NO: 849 - DNA, 23 bp, Artificial Sequence
  Description of Artificial Sequence: Synthetic oligonucleotide
tgtgggtgagtgtgtgtgtgtgg

SEQ ID NO: 850 - DNA, 23 bp, Artificial Sequence
  Description of Artificial Sequence: Synthetic oligonucleotide
tgtgagtgagtgtgtgtgtgtga

SEQ ID NO: 851 - DNA, 23 bp, Artificial Sequence
  Description of Artificial Sequence: Synthetic oligonucleotide
agtgagtgagtgagtgagtgagg

SEQ ID NO: 852 - DNA, 23 bp, Artificial Sequence
  Description of Artificial Sequence: Synthetic oligonucleotide
gatgagtgagtgagtgagtgggg

SEQ ID NO: 853 - DNA, 23 bp, Artificial Sequence
  Description of Artificial Sequence: Synthetic oligonucleotide
agtgagtaagtgagtgagtgagg

SEQ ID NO: 854 - DNA, 23 bp, Artificial Sequence
  Description of Artificial Sequence: Synthetic oligonucleotide
agtgagtatgtgtgtgtgtgggg

SEQ ID NO: 855 - DNA, 23 bp, Artificial Sequence
  Description of Artificial Sequence: Synthetic oligonucleotide
gatgagtgtgtgtgtgtgtgagg

SEQ ID NO: 856 - DNA, 23 bp, Artificial Sequence
  Description of Artificial Sequence: Synthetic oligonucleotide
ggtgtgtgagtgtgagtgtgggg

SEQ ID NO: 857 - DNA, 23 bp, Artificial Sequence
  Description of Artificial Sequence: Synthetic oligonucleotide
ggtgagtgtgtgtgtgcatgtgg

SEQ ID NO: 858 - DNA, 23 bp, Artificial Sequence
  Description of Artificial Sequence: Synthetic oligonucleotide
gatgagtcagtgagtgagtgggg

SEQ ID NO: 859 - DNA, 23 bp, Artificial Sequence
  Description of Artificial Sequence: Synthetic oligonucleotide
ggtgagtcagtgtgtgagtgagg

SEQ ID NO: 860 - DNA, 23 bp, Artificial Sequence
  Description of Artificial Sequence: Synthetic oligonucleotide
agtgagtgagtatgtgtgtatgg

SEQ ID NO: 861 - DNA, 23 bp, Artificial Sequence
  Description of Artificial Sequence: Synthetic oligonucleotide
ggtgagtgagtgagtgagtgagg

SEQ ID NO: 862 - DNA, 23 bp, Artificial Sequence
  Description of Artificial Sequence: Synthetic oligonucleotide
tgtgagtgagtgtgtgtgtgtga

SEQ ID NO: 863 - DNA, 23 bp, Artificial Sequence
  Description of Artificial Sequence: Synthetic oligonucleotide
ggtgagagagtgtgtgcgtagga

SEQ ID NO: 864 - DNA, 23 bp, Artificial Sequence
  Description of Artificial Sequence: Synthetic oligonucleotide
ggagagtgagtgtgtgcatgtgc

SEQ ID NO: 865 - DNA, 23 bp, Artificial Sequence
  Description of Artificial Sequence: Synthetic oligonucleotide
tgtgagtgggtgtgtgcatgtgg

SEQ ID NO: 866 - DNA, 23 bp, Artificial Sequence
  Description of Artificial Sequence: Synthetic oligonucleotide
agtgagtgagtgtgtgtgtgaga

SEQ ID NO: 867 - DNA, 23 bp, Artificial Sequence
  Description of Artificial Sequence: Synthetic oligonucleotide
tgtgagtgagtgtgtgtgtgtga

SEQ ID NO: 868 - DNA, 23 bp, Artificial Sequence
  Description of Artificial Sequence: Synthetic oligonucleotide
aatgagtgagtgtgtgtgtgtga

SEQ ID NO: 869 - DNA, 23 bp, Artificial Sequence
  Description of Artificial Sequence: Synthetic oligonucleotide
ggtgagcaagtgtgtgtgtgtgg

SEQ ID NO: 870 - DNA, 23 bp, Artificial Sequence
  Description of Artificial Sequence: Synthetic oligonucleotide
ctggagtgagtgtgtgtgtgtgg

SEQ ID NO: 871 - DNA, 23 bp, Artificial Sequence
  Description of Artificial Sequence: Synthetic oligonucleotide
ggtgagtaggtgtgtgtgtgggg

SEQ ID NO: 872 - DNA, 22 bp, Artificial Sequence
  Description of Artificial Sequence: Synthetic oligonucleotide
ggggtgtgggtgtgggggtgtg

SEQ ID NO: 873 - DNA, 23 bp, Artificial Sequence
  Description of Artificial Sequence: Synthetic oligonucleotide
cgtgagtgagtgtgtacctgggg

SEQ ID NO: 874 - DNA, 27 bp, Artificial Sequence
  Description of Artificial Sequence: Synthetic oligonucleotide
gcaaccacaaacccacgagggcagagt

SEQ ID NO: 875 - DNA, 27 bp, Artificial Sequence
  Description of Artificial Sequence: Synthetic oligonucleotide
acaaacacatacccacaaggacagagt

SEQ ID NO: 876 - DNA, 27 bp, Artificial Sequence
  Description of Artificial Sequence: Synthetic oligonucleotide
gcaatcacaataccacaagggaagagg

SEQ ID NO: 877 - DNA, 27 bp, Artificial Sequence
  Description of Artificial Sequence: Synthetic oligonucleotide
  modified_base (22)..(23): a, c, t, g, unknown or other
gtagggccttcgcgcacctcanngrrt

SEQ ID NO: 878 - DNA, 27 bp, Artificial Sequence
  Description of Artificial Sequence: Synthetic oligonucleotide
gtagggccttcgcgcacctcatggaat

SEQ ID NO: 879 - DNA, 27 bp, Artificial Sequence
  Description of Artificial Sequence: Synthetic oligonucleotide
  modified_base (22)..(23): a, c, t, g, unknown or other
gcaaggcccggcgcacggtggnngrrt

SEQ ID NO: 880 - DNA, 27 bp, Artificial Sequence
  Description of Artificial Sequence: Synthetic oligonucleotide
gcaaggcccggcgcacggtggcggggt

SEQ ID NO: 881 - DNA, 27 bp, Artificial Sequence
  Description of Artificial Sequence: Synthetic oligonucleotide
ctgaggcccggcccacggtggtgagga

SEQ ID NO: 882 - DNA, 27 bp, Artificial Sequence
  Description of Artificial Sequence: Synthetic oligonucleotide
acaaggctcagaacacggtgagaaagt

SEQ ID NO: 883 - DNA, 27 bp, Artificial Sequence
  Description of Artificial Sequence: Synthetic oligonucleotide
gcaaggccccaggcatggtggcacagt

SEQ ID NO: 884 - DNA, 27 bp, Artificial Sequence
  Description of Artificial Sequence: Synthetic oligonucleotide
  modified_base (22)..(23): a, c, t, g, unknown or other
gaaagagagatgtagggctagnngrrt

SEQ ID NO: 885 - DNA, 27 bp, Artificial Sequence
  Description of Artificial Sequence: Synthetic oligonucleotide
gaaagagagatgtagggctagaggggt

SEQ ID NO: 886 - DNA, 27 bp, Artificial Sequence
  Description of Artificial Sequence: Synthetic oligonucleotide
gaaagaggcatgtagggctacagaggc

SEQ ID NO: 887 - DNA, 27 bp, Artificial Sequence
  Description of Artificial Sequence: Synthetic oligonucleotide
gaaagagagaaatagggctagaacaaa

SEQ ID NO: 888 - DNA, 29 bp, Artificial Sequence
  Description of Artificial Sequence: Synthetic oligonucleotide
  modified_base (24)..(25): a, c, t, g, unknown or other
gtactcacctctcatgaagcactnngrrt

SEQ ID NO: 889 - DNA, 29 bp, Artificial Sequence
  Description of Artificial Sequence: Synthetic oligonucleotide
gtactcacctctcatgaagcactgtgggt

SEQ ID NO: 890 - DNA, 29 bp, Artificial Sequence
  Description of Artificial Sequence: Synthetic oligonucleotide
tacctcacctgccaggaagcacttgaaat

SEQ ID NO: 891 - DNA, 27 bp, Artificial Sequence
  Description of Artificial Sequence: Synthetic oligonucleotide
gggtgagtgagtgtgtgcgtgtggggt

SEQ ID NO: 892 - DNA, 27 bp, Artificial Sequence
  Description of Artificial Sequence: Synthetic oligonucleotide
gggtgagtcagtgagtgcgtggtgagt

SEQ ID NO: 893 - DNA, 27 bp, Artificial Sequence
  Description of Artificial Sequence: Synthetic oligonucleotide
gagcgagtgggtgtgtgcgtggggggt

SEQ ID NO: 894 - DNA, 27 bp, Artificial Sequence
  Description of Artificial Sequence: Synthetic oligonucleotide
gggtgagtcagtgagtgcgtgatgagt

SEQ ID NO: 895 - DNA, 27 bp, Artificial Sequence
  Description of Artificial Sequence: Synthetic oligonucleotide
gagtgaatgagtgtgtgtgtgtggggt

SEQ ID NO: 896 - DNA, 27 bp, Artificial Sequence
  Description of Artificial Sequence: Synthetic oligonucleotide
gggtgagtcagtgtgtgagtggtgagt

SEQ ID NO: 897 - DNA, 27 bp, Artificial Sequence
  Description of Artificial Sequence: Synthetic oligonucleotide
gggtgagtcagtgagtgcgtggtgagt

SEQ ID NO: 898 - DNA, 27 bp, Artificial Sequence
  Description of Artificial Sequence: Synthetic oligonucleotide
gtgtgagtgtgtgtgtgcgtacagggt

SEQ ID NO: 899 - DNA, 27 bp, Artificial Sequence
  Description of Artificial Sequence: Synthetic oligonucleotide
gagtgagtgagtgtgtgtgtggggggg

SEQ ID NO: 900 - DNA, 27 bp, Artificial Sequence
  Description of Artificial Sequence: Synthetic oligonucleotide
gggtgagtcagtgtgtgggtggtgagt

SEQ ID NO: 901 - DNA, 27 bp, Artificial Sequence
  Description of Artificial Sequence: Synthetic oligonucleotide
gggtgagtcagtgtgtgagtggtgagt

SEQ ID NO: 902 - DNA, 27 bp, Artificial Sequence
  Description of Artificial Sequence: Synthetic oligonucleotide
gggtgagtcagtgtgtgagtggagagt

SEQ ID NO: 903 - DNA, 27 bp, Artificial Sequence
  Description of Artificial Sequence: Synthetic oligonucleotide
gggtgagtcagtgtgtgagtggtgagt

SEQ ID NO: 904 - DNA, 27 bp, Artificial Sequence
  Description of Artificial Sequence: Synthetic oligonucleotide
gagtgagtaagtgtgtgtgtgtgtggt

SEQ ID NO: 905 - DNA, 27 bp, Artificial Sequence
  Description of Artificial Sequence: Synthetic oligonucleotide
gggtgtgtgtctgtgtgcgtgtggggt

SEQ ID NO: 906 - DNA, 27 bp, Artificial Sequence
  Description of Artificial Sequence: Synthetic oligonucleotide
gggtgagtcagtgtgtgagtggtgagt

SEQ ID NO: 907 - DNA, 27 bp, Artificial Sequence
  Description of Artificial Sequence: Synthetic oligonucleotide
ggatgagtgagtgagtgagtggggagt

SEQ ID NO: 908 - DNA, 27 bp, Artificial Sequence
  Description of Artificial Sequence: Synthetic oligonucleotide
gggtgagtcactgtgtgagtggtgagt

SEQ ID NO: 909 - DNA, 27 bp, Artificial Sequence
  Description of Artificial Sequence: Synthetic oligonucleotide
gggagagagagtgtgtgcgtgtgtggt

SEQ ID NO: 910 - DNA, 27 bp, Artificial Sequence
  Description of Artificial Sequence: Synthetic oligonucleotide
ggctgaatgtgtgtgtgcgtgaatgat

SEQ ID NO: 911 - DNA, 27 bp, Artificial Sequence
  Description of Artificial Sequence: Synthetic oligonucleotide
aggtgaccgtgtgtgtgcgtggagggt

SEQ ID NO: 912 - DNA, 27 bp, Artificial Sequence
  Description of Artificial Sequence: Synthetic oligonucleotide
gtatgggtgagagtgtgcgtgcacagt

SEQ ID NO: 913 - DNA, 27 bp, Artificial Sequence
  Description of Artificial Sequence: Synthetic oligonucleotide
gtgggtgtgggggtgtgggtgttgggg

SEQ ID NO: 914 - DNA, 27 bp, Artificial Sequence
  Description of Artificial Sequence: Synthetic oligonucleotide
gggtgagtcagtgtgtgagtggtgagt

SEQ ID NO: 915 - DNA, 27 bp, Artificial Sequence
  Description of Artificial Sequence: Synthetic oligonucleotide
gggtgagtcagtgtgtgagtggtgagt

SEQ ID NO: 916 - DNA, 27 bp, Artificial Sequence
  Description of Artificial Sequence: Synthetic oligonucleotide
gaatgagtgtgtgtgtgtgtgtgcagt

SEQ ID NO: 917 - DNA, 27 bp, Artificial Sequence
  Description of Artificial Sequence: Synthetic oligonucleotide
gagtgagtgtgtgtgtgtgagagagag

SEQ ID NO: 918 - DNA, 27 bp, Artificial Sequence
  Description of Artificial Sequence: Synthetic oligonucleotide
ggatgagtgagtgagtgcatgttgagt

SEQ ID NO: 919 - DNA, 27 bp, Artificial Sequence
  Description of Artificial Sequence: Synthetic oligonucleotide
tggggtgtgggtgtgtgggtgtggggg

SEQ ID NO: 920 - DNA, 27 bp, Artificial Sequence
  Description of Artificial Sequence: Synthetic oligonucleotide
gggtgagtgagtgagtgagtggtgggt

SEQ ID NO: 921 - DNA, 27 bp, Artificial Sequence
  Description of Artificial Sequence: Synthetic oligonucleotide
gggtgagtgagtgagtgagtggtgagt

SEQ ID NO: 922 - DNA, 27 bp, Artificial Sequence
  Description of Artificial Sequence: Synthetic oligonucleotide
gagtgagtcagtgtgtgagtggtgagt

SEQ ID NO: 923 - DNA, 27 bp, Artificial Sequence
  Description of Artificial Sequence: Synthetic oligonucleotide
aagtgagtgagtgtgtgtgtgcaaaac

SEQ ID NO: 924 - DNA, 27 bp, Artificial Sequence
  Description of Artificial Sequence: Synthetic oligonucleotide
gaatgagtgagtgtgtgtgtaagaagt

SEQ ID NO: 925 - DNA, 27 bp, Artificial Sequence
  Description of Artificial Sequence: Synthetic oligonucleotide
gtgtgtgttggggtgtgggtgtggggg

SEQ ID NO: 926 - DNA, 28 bp, Artificial Sequence
  Description of Artificial Sequence: Synthetic oligonucleotide
gtgtggtttcagaaccggaggatgaagc

SEQ ID NO: 927 - DNA, 28 bp, Artificial Sequence
  Description of Artificial Sequence: Synthetic oligonucleotide
gtgtggttccagaaccggaggacaaagt

SEQ ID NO: 928 - DNA, 28 bp, Artificial Sequence
  Description of Artificial Sequence: Synthetic oligonucleotide
atctggttccagaaccggaggatgaagt

SEQ ID NO: 929 - DNA, 28 bp, Artificial Sequence
  Description of Artificial Sequence: Synthetic oligonucleotide
atctggttccagaaccgaaggatgaagt

SEQ ID NO: 930 - DNA, 28 bp, Artificial Sequence
  Description of Artificial Sequence: Synthetic oligonucleotide
gtgtggttccagaaccgaaggatgaagt

SEQ ID NO: 931 - DNA, 28 bp, Artificial Sequence
  Description of Artificial Sequence: Synthetic oligonucleotide
atctggttccagaaccggaggatgaagt

SEQ ID NO: 932 - DNA, 28 bp, Artificial Sequence
  Description of Artificial Sequence: Synthetic oligonucleotide
gtgtggttccagaaccggcggatgaagt

SEQ ID NO: 933 - DNA, 28 bp, Artificial Sequence
  Description of Artificial Sequence: Synthetic oligonucleotide
gtatggtttcagaaccgaagaacaaagt

SEQ ID NO: 934 - DNA, 28 bp, Artificial Sequence
  Description of Artificial Sequence: Synthetic oligonucleotide
atctggtttcagaaccggaggatgaagt

SEQ ID NO: 935 - DNA, 28 bp, Artificial Sequence
  Description of Artificial Sequence: Synthetic oligonucleotide
atctggttccagaaccgcaggatgaagt

SEQ ID NO: 936 - DNA, 28 bp, Artificial Sequence
  Description of Artificial Sequence: Synthetic oligonucleotide
ttatggttccagaaacgaaggaagcaat

SEQ ID NO: 937 - DNA, 28 bp, Artificial Sequence
  Description of Artificial Sequence: Synthetic oligonucleotide
ccaaggtcccggaaccgaaggaggaagg

SEQ ID NO: 938 - DNA, 28 bp, Artificial Sequence
  Description of Artificial Sequence: Synthetic oligonucleotide
acgtggtaccagaatcggaggatgaagt

SEQ ID NO: 939 - DNA, 28 bp, Artificial Sequence
  Description of Artificial Sequence: Synthetic oligonucleotide
acctggttccagaaccagaggatgaaat

SEQ ID NO: 940 - DNA, 28 bp, Artificial Sequence
  Description of Artificial Sequence: Synthetic oligonucleotide
gtatggccccagaacagaaggaaagaat

SEQ ID NO: 941 - DNA, 28 bp, Artificial Sequence
  Description of Artificial Sequence: Synthetic oligonucleotide
gtctggttccagaaccgaagggccaagt

SEQ ID NO: 942 - DNA, 27 bp, Artificial Sequence
  Description of Artificial Sequence: Synthetic oligonucleotide
cctcagcctgagtgttgaggctgcggt

SEQ ID NO: 943 - DNA, 27 bp, Artificial Sequence
  Description of Artificial Sequence: Synthetic oligonucleotide
gctcagcctgagtgttgaggccccagt

SEQ ID NO: 944 - DNA, 28 bp, Artificial Sequence
  Description of Artificial Sequence: Synthetic oligonucleotide
gctgcagactgagtgttaaggccggagt

SEQ ID NO: 945 - DNA, 27 bp, Artificial Sequence
  Description of Artificial Sequence: Synthetic oligonucleotide
gttcagcccaagtgttgagactcaggt

SEQ ID NO: 946 - DNA, 28 bp, Artificial Sequence
  Description of Artificial Sequence: Synthetic oligonucleotide
cttgagcctgggtgtttgaggctgcagt

SEQ ID NO: 947 - DNA, 27 bp, Artificial Sequence
  Description of Artificial Sequence: Synthetic oligonucleotide
actgagcctgagggttgaggctgcagt

SEQ ID NO: 948 - DNA, 27 bp, Artificial Sequence
  Description of Artificial Sequence: Synthetic oligonucleotide
acacagccagagggttgaggcggaggt

SEQ ID NO: 949 - DNA, 27 bp, Artificial Sequence
  Description of Artificial Sequence: Synthetic oligonucleotide
tatcagcttgagttttgaggctgagat

SEQ ID NO: 950 - DNA, 28 bp, Artificial Sequence
  Description of Artificial Sequence: Synthetic oligonucleotide
cttgagccctgaatgttgaggctgcagt

SEQ ID NO: 951 - DNA, 28 bp, Artificial Sequence
  Description of Artificial Sequence: Synthetic oligonucleotide
tttgagccctgagtgttgaggctgcagt

SEQ ID NO: 952 - DNA, 27 bp, Artificial Sequence
  Description of Artificial Sequence: Synthetic oligonucleotide
ggctctccgaggagaaggccaagtggt

SEQ ID NO: 953 - DNA, 27 bp, Artificial Sequence
  Description of Artificial Sequence: Synthetic oligonucleotide
ggctctccgatgggagggccagagaat

SEQ ID NO: 954 - DNA, 27 bp, Artificial Sequence
  Description of Artificial Sequence: Synthetic oligonucleotide
ggctctctggggagaaagccagggagc

SEQ ID NO: 955 - DNA, 27 bp, Artificial Sequence
  Description of Artificial Sequence: Synthetic oligonucleotide
ggctctcagaggagaaggccgagggga

SEQ ID NO: 956 - DNA, 27 bp, Artificial Sequence
  Description of Artificial Sequence: Synthetic oligonucleotide
agttctccaaggagaagaccacgtggt

SEQ ID NO: 957 - DNA, 27 bp, Artificial Sequence
  Description of Artificial Sequence: Synthetic oligonucleotide
aactctcccaggagaaggcccagaaat

SEQ ID NO: 958 - DNA, 28 bp, Artificial Sequence
  Description of Artificial Sequence: Synthetic oligonucleotide
gcgcccactgcaaggcccggcgcacggt

SEQ ID NO: 959 - DNA, 28 bp, Artificial Sequence
  Description of Artificial Sequence: Synthetic oligonucleotide
gcgcccactgcagggcccggctgcggag

SEQ ID NO: 960 - DNA, 27 bp, Artificial Sequence
  Description of Artificial Sequence: Synthetic oligonucleotide
gtgcccacccagggcccggcacagagt

SEQ ID NO: 961 - DNA, 28 bp, Artificial Sequence
  Description of Artificial Sequence: Synthetic oligonucleotide
aggcccactgcaaggcccagtgggcggc

SEQ ID NO: 962 - DNA, 27 bp, Artificial Sequence
  Description of Artificial Sequence: Synthetic oligonucleotide
gtgcccacccagggcccggcacagagt

SEQ ID NO: 963 - DNA, 27 bp, Artificial Sequence
  Description of Artificial Sequence: Synthetic oligonucleotide
ggggtcccaggtgctgacgtaggtagt

SEQ ID NO: 964 - DNA, 29 bp, Artificial Sequence
  Description of Artificial Sequence: Synthetic oligonucleotide
  modified_base (22)..(29): a, c, t, g, unknown or other
ggggcacgggcagcttgcccgnnnnnnnn

SEQ ID NO: 965 - DNA, 29 bp, Artificial Sequence
  Description of Artificial Sequence: Synthetic oligonucleotide
  modified_base (22)..(29): a, c, t, g, unknown or other
ggtcgccctcgaacttcacctnnnnnnnn

SEQ ID NO: 966 - protein, 5 aa, Artificial Sequence
  Description of Artificial Sequence: Synthetic peptide
IIKKG

SEQ ID NO: 967 - protein, 359 aa, Artificial Sequence
  Description of Artificial Sequence: Synthetic polypeptide
NKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKHPQIIKKG

SEQ ID NO: 968 - protein, 359 aa, Artificial Sequence
  Description of Artificial Sequence: Synthetic polypeptide
NKGYKHHAEDALIIANADFIFKEWKRLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVKSKCYEEAKKLKKISNQAEFIASFYNNDLIKINGELYRVIGVNNDLLNRIEVNMIDITYREYLENMNDKRPPHIIKTIASKTQSIKKYSTDILGNLYEVKSNKHPQIIKKG

SEQ ID NO: 969 - protein, 359 aa, Artificial Sequence
  Description of Artificial Sequence: Synthetic polypeptide
NKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKELINKSPEKLLMYHHDPQTYQKLKLIMEQYGDEKNPLYKYYEETGNYLTKYSKKDNGPVIKKIKYYGNKLNAHLDITDDYPNSRNMVVKLSLKPYRFDVYLDNGVYKFVTVKNLDVIKKENYYEVNSKCYEEAKKLKKISNQAEFMASFYKNDLIKFNGELYRVIGVNNDLLNRIEVNMIDITYREYLENMNDKRPPHIIKTIASKTQSIKKYSTDILGNLYEVKSKKHPQIIKKG

SEQ ID NO: 970 - protein, 359 aa, Artificial Sequence
  Description of Artificial Sequence: Synthetic polypeptide
NKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLNITDDYPNSRNKVVKLSLKPYRFDVYLDNGVYKFVTVKNLDVIKKENYYEVNSKCYEEAKKLKKISNQAEFISSFYSNDLIKINGELYRVIGVNNDLLNRIEVNMIDITYREYLENMNDKRPPHIIKRIASKTQSIKKYSTDILGNLYEVKSKKHPQIIKKG

SEQ ID NO: 971 - protein, 359 aa, Artificial Sequence
  Description of Artificial Sequence: Synthetic polypeptide
NKGYKHHAEDALIIANADFIFKEWKKLDKAKKVMENQMFEEKQAESMPEIETEQEYKEIVITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPHIIKTIASKTQSIKKYSTDILGNLYEVKSKKHPEIIKKG

SEQ ID NO: 972 - protein, 359 aa, Artificial Sequence
  Description of Artificial Sequence: Synthetic polypeptide
NKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIRINGELYRVIGVNNDLLNRIEVNMIDITYREYLENMNDKRPPHIIKTIASKTQSIKKYSTDILGNLYEVKSKKHPQIIKKG

SEQ ID NO: 973 - protein, 359 aa, Artificial Sequence
  Description of Artificial Sequence: Synthetic polypeptide
NKGYKHHAEDALIIANADFIFKEWKKLDKAKKVMENQMFEEKQAESMPEIETEQEYKEIFITPHQIKHIKDFKDFKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDNYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYRGYLENMNDKRPPHIIKTIASKTQSIKKYSTDILGNLYEVKSKKHPQIIKKG

SEQ ID NO: 974 - protein, 359 aa, Artificial Sequence
  Description of Artificial Sequence: Synthetic polypeptide
NKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMKDKRPPHIIKTIASKTQSIIKYSTDILGNLYEVKSKKHPQIIKKG

SEQ ID NO: 975 - protein, 359 aa, Artificial Sequence
  Description of Artificial Sequence: Synthetic polypeptide
NKGYKHHAEDALIIANADFIFKEWKKLDKAKKVMENQMFEEKQAESMPEIETEHEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPHIIKTIASKTQSIKKYSTDILGNLYEVKSNKHPQIIKKG

SEQ ID NO: 976 - protein, 359 aa, Artificial Sequence
  Description of Artificial Sequence: Synthetic polypeptide
NKGYKHHAEDALIIANADFIFKEWKKLDKAKKVMENQMFEEKQAESMPEIETEQEYKEIFITPHQIKHINDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPHIIKTIASKTQSIKKYSTDILGNLYEVKSKKRPQIIKKG

SEQ ID NO: 977 - protein, 359 aa, Artificial Sequence
  Description of Artificial Sequence: Synthetic polypeptide
NKGYKHHAEDALIIANADFIFKEWKKLDKAKKLMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVRNLDVIKKENHYEVNSKCYEEAKKLKKISNQAEFIASFYNNDLIKINGELYRVIGVNNDLLNRIEVNMIDITYREYLENMNDKRPPQIIKTIASKTQSIKKYSTDILGNLYEVKSKKHPQIIKKG

SEQ ID NO: 978 - protein, 359 aa, Artificial Sequence
  Description of Artificial Sequence: Synthetic polypeptide
NKGYKHHAEDALIIANADFIFKEWKKLDKAKKVMENQMFEEKQAESKPEIETEQEYKEIFITPHQIKHIKDFKDYKYSHRVDKKPNRKLINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNTKCYEEAKKLKKISNQAEFIASFYNNDLIKINGELYRVIGVNNDLLNRIEVNMIDITYREYLENMNDKRPPQIIKTIASKTQSIKKYSTDILGNLYEVKSKKHPQIVKKG

SEQ ID NO: 979 - protein, 359 aa, Artificial Sequence
  Description of Artificial Sequence: Synthetic polypeptide
NKGYKHHAEDALIIANADFIFKEWKKLDRAKKVMENQMFEEKQAESMPEIETEQEYKEIFITPHQIKHIKDFKDYKYSHRVDKKPNRELINDTLYSTRKDDKGYTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPQIIKTITSKTQSIKKYSTDILGNLYEVKSKKQPQIIKKG

SEQ ID NO: 980 - protein, 359 aa, Artificial Sequence
  Description of Artificial Sequence: Synthetic polypeptide
NKGYKHHAEDALIIANADFIFKEWKKLDKAKKVMENQMFEEKQAESMPEIETEQEYKEIFITPHQIKHIKDFKDYKYSHRVDKKPNRKLINDTLYSTRKDDKGNTLIVNNLNGLYDKDNDKLKKLINKSPEKLLMYHHDPQTYQKLKLILEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPQIIKTIASKTQSIKKYSTDILGNLYEVKSKKHPQIIKKG

SEQ ID NO: 981 - protein, 359 aa, Artificial Sequence
  Description of Artificial Sequence: Synthetic polypeptide
NKGYKHHAEDALIIANADFIFKEWKKLDKAKKVMENQMFEEKQAESMPEIETEQEYKEIFITPHQIKHIKDFKDYKYSHRVDKKPNRKLINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGIYKFVTVKNMDVIKKENYYEVNSKCYEEAKKLKKISNQAEFIASFYNNDLIKINGELYRVIGVNNDLLNRIEVNMIDITYREYIENMNDKRPPQIIKTIASKTQSIKKYSTDILGNLYEVKSKKHPQIIKKG

SEQ ID NO: 982 - protein, 359 aa, Artificial Sequence
  Description of Artificial Sequence: Synthetic polypeptide
NKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVRNLDVIKKENYYEVNSKCYEEAKKLKKISNQAEFIASFYNNDLIKINGELYRVIGVNNDLLNRIEVNMIDITYREYLENMNDKRPPQIIKTIASKTQSIKKYSTDILGNLYEVKSKKHPQVIKKG

SEQ ID NO: 983 - protein, 357 aa, Artificial Sequence
  Description of Artificial Sequence: Synthetic polypeptide
NKGYKHHAEDALIIANADFIFKEWKRLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDDKNPLYKYYEETGNYLIKYSKKDNGPVIKKIKYYGNKLNAHLDITDDYPNSRNKVVKLSLKPYRFDVYLDNGVYKFVTVRNLDVIKKENYYEVNSKCYEEAKKLKKISNQAEFIAYFYNNDLIKINGELYRVIGVNNDLLNRIEVNMIDITYREYLENMNDKRPPQIIKTIASKTQSIKKYSTDILGNLYEVKSKKHPQIIK

SEQ ID NO: 984 - protein, 359 aa, Artificial Sequence
  Description of Artificial Sequence: Synthetic polypeptide
NKGYKHHAEDALIIANADFIFKEWKKLDKAKKVMENQMFEEKQAESMPEIETEQEYKEIFITPHQIKHIKDFKDYKYSHRVDKKPNRKLINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPQIIKTIASKTQSIKKYSTDILGNLYEVKSKKHPQITKKG

SEQ ID NO: 985 - protein, 356 aa, Artificial Sequence
  Description of Artificial Sequence: Synthetic polypeptide
NKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDQQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKNENYYEVNSKCYEEAKKLKKISNQAEFIASFYNNDLIKINGELYRVIGVNNDLLNRIEVNMIDITYREYLENMNDKRPPQNIKTIASKTQSIKKYSTDILGNLYEVKSKKHPQII

SEQ ID NO: 986 - protein, 359 aa, Artificial Sequence
  Description of Artificial Sequence: Synthetic polypeptide
NKGYKHHAEDALIIANADFIFKEWKKLDKAKKVMENQMFEEKQAESMPEIETEQEYKEIFITPHQIKHIKDFKDYKYSHRVDKKPNRKLINDTLYSTRKDDKGNTLIVNNLNGLYDKDNDKLKKLINKSPEKLLMYHHDPQTYQKLKLIMEQYGDEKNPLYKYYEETGYYLTKYSKKDNGPVIKKIKYYGNKINAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPQIIKTIASKTQSIKKYSTDILGNLYEVKSKKHPQIVKKG

SEQ ID NO: 987 - protein, 359 aa, Artificial Sequence
  Description of Artificial Sequence: Synthetic polypeptide
NKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPQIIKTIASKTQSIKKYSTDILGNLYEVKSKKHPQIIKKG

SEQ ID NO: 988 - protein, 359 aa, Artificial Sequence
  Description of Artificial Sequence: Synthetic polypeptide
NKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYKNDLIKINGELYRVIGVNNDLLNRIEVNMIDITYREYLENMNDKRPPQIIKTIASKTQSIKKYSTDILGNLYEVKSKKHPQIIKKG

SEQ ID NO: 989 - protein, 359 aa, Artificial Sequence
  Description of Artificial Sequence: Synthetic polypeptide
NKGYKHHAEDALIIANADFIFKEWKKLDKAKKLMENQMFEEKQAESMPEIETEQEYKEIFMTPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYHEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPHIIKTIASKTQSIKKYSTDILGNLYEVKSKKHPQIIKKG

SEQ ID NO: 990 - protein, 353 aa, Artificial Sequence
  Description of Artificial Sequence: Synthetic polypeptide
NKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDIGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNYKRPPQIIKTIASKTQSIKKYSSDILGNLYEVKSKKHP

SEQ ID NO: 991 - protein, 359 aa, Artificial Sequence
  Description of Artificial Sequence: Synthetic polypeptide
NKGYKHHAEDALIIANADFIFKEWKKLDKAKKVMENQMFEEKQAESMPEIETEQEYKEIFITPHQIKHIKDFKDYKYSHRVDKKPNRKLINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPQIINTIASKTQSIKKYSTDILGNLYEVKSKKHPQIIKKG

SEQ ID NO: 992 - protein, 359 aa, Artificial Sequence
  Description of Artificial Sequence: Synthetic polypeptide
NKGYKHHAEDALIIANADFIFKEWKKLDKAKKVMENQMFEEKQAESMPEIETEQEYKELFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYKNDLIKINGELYRVIGVNNDLLNRIEVNMIDITYREYLENMNDKRPPQIIKTIASKTQSIKKCSTDILGNLYEVKSKKHPQIIKKG

SEQ ID NO: 993 - protein, 359 aa, Artificial Sequence
  Description of Artificial Sequence: Synthetic polypeptide
NKGYKHHAEDALIIANADFIFKEWKKLDKAKKVMENQMFEKKQAESMPEIETEQEYKEIFITPHQIKHIKDFKDYKYSHRVDKKPNRGLINDTLYSTRKDDKGNTLIVNNLNGLYDKDNDKLKKLINKSPEKLLMYHHDPQTYQKLKLIMEQYGDEKNPLYKYYEDTGNYLTKYSKKDNGPVIKKIKYYGNKLNAHLDITDDYPNSRNKVVKLSLKPYRFDVYLDNGVYKFVTVKNLDLIKKENYYEVNSKCYEEAKKLKKISNQAEFIASFYNNDLIKINGELYRVIGVNNDLLNRIEVNMIDITYREYLENVNDKRPPQIIKTIASKTQSIKKYSTDILGNLYEVKSKKHPQIIKKG

SEQ ID NO: 994 - protein, 359 aa, Artificial Sequence
  Description of Artificial Sequence: Synthetic polypeptide
NKGYKHHAEDALIIANADFIFKEWKKLDKAKKVMENQMFEEKQAESMPEIETEQEYKEIFITPHQIKHIKDFKDYKYSHRVDKKPNRKLINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGIYKFVTVKNLDVIKKENYYEVNSKCYEKAKKLKKISNQAEFIASFYNNDLIKINGELYRVIGVNNDLLNRIEVNMIDITYREYLENMNDKRPPQIIKTIASKTQSIKKYSTDILGNLYEVKSNKHPQIIKKG

SEQ ID NO: 995 - protein, 359 aa, Artificial Sequence
  Description of Artificial Sequence: Synthetic polypeptide
NKGYKHHAEDALIIANADFIFKEWKKLDKAKKVMENQMFEEKQAESMPEIETEQEYKEIFIIPHQIKHIKDFKDYKYSHRVDKKPNRKLINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPQIIKTIASKTQSIKKYSTDILGNLYEVKSKKHPQIIKKG

SEQ ID NO: 996 - protein, 359 aa, Artificial Sequence
  Description of Artificial Sequence: Synthetic polypeptide
NKGYKHHAEDALIIANADFIFKEWKKLDKAKKVMENQMFEEKQAESMPEIETQQEYKEIFITPHQIKHIKDFKDYKYSHRVDKKPNRKLINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASYYNNDLIKINGELYRVIGVNNDLLNRIEVKMIDITYREYLENMNDKRPPQIIKTIASKTQSIKKYSTDILGNLYEVKSKKHPHIIKKG

SEQ ID NO: 997 - protein, 359 aa, Artificial Sequence
  Description of Artificial Sequence: Synthetic polypeptide
NKGYKHHAEDALIIANADFIFKEWKKLDKAKKVMENQMFEEKQAESMPEIETEQEYKEIFITPHQIKHIKDFKDYKYSHRVDKKPNRKLINDTLYSTRKDDKGNTLIVNILNGLYDKDNDKLKKLINKSPEKLLMYHHDPQTYQKLKLIMEQYGDEKNPLYKYYEETGNYLTKYSKKDNGPVIKKIRYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPQIIKTIASKTQSIKKYSTDILGNLYEVKSKKHPQIIKKG

SEQ ID NO: 998 - protein, 359 aa, Artificial Sequence
  Description of Artificial Sequence: Synthetic polypeptide
NKGYKHHAEDALIIANADFIFKEWKKLDKAKKVMENQMFEEKQAESMPEIETEQEYKEIFITPHQIKHIKDFKDYKYSHRVDKKPNRKLINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYFENMNVKRPPQIIKTIASKTQSIKKYSTDILGNLYEVKSKKHPQIIKKG

SEQ ID NO: 999 - protein, 359 aa, Artificial Sequence
  Description of Artificial Sequence: Synthetic polypeptide
NKGYKHHAEDALIIANADFIFKEWKKLDKAKKVMENQMFEEKQAESMPEIETEQEYKEIFITPHQIKHIKDFKDYKYSHRVDKKHNRELVNDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPQIIKTITSKTQSIKKYSTDILGNLYEVKSKKHPQIIKKG

SEQ ID NO: 1000 - protein, 359 aa, Artificial Sequence
  Description of Artificial Sequence: Synthetic polypeptide
NKGYKHHAEDALIIANADFIFKEWKKLDKAKKVMENQMFEEKQAESMPEIETEQEYKEIFITPHQIKHIMDFKDYKYSHRVDKKPNRELINDTLYSTRKDEKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVRNLDVIKKENYYEVNSKCYEEAKKLKKISNQAEFIASFYNNDLIKINGELYRVIGVNNDLLNRIEVNMIDITYREYLENMNDKRPPQIIKTIASKTQSIKKYSTDILGNLYEVKSKKHPQIIKKG

SEQ ID NO: 1001 - protein, 359 aa, Artificial Sequence
  Description of Artificial Sequence: Synthetic polypeptide
NKGYKHHAEDALIIANADFIFKEWKKLDKAKKVMENQMFEEKQAVSMPEIETEQEYKEIFINPHQIKHIKDFKDYKYSHRVDKKPNRELINDTLYSTRKDDKGNTLIVNNLNGLYDKYNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSRKPYRFDVYLDNGVYKFVTVKNLDVIKKENYYEVNSKCYEEAKKLKKISNQAEFIASFYNNDLIKINGELYRVIGVNNDLLNRIEVNMIDITYREYRENMNDKRPPQIIKTIASKTQSIKKYSTDILGNLYEVKSKKHPQIIKKG

SEQ ID NO: 1002 - protein, 359 aa, Artificial Sequence
  Description of Artificial Sequence: Synthetic polypeptide
NKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKNENYYEVNSKCYEEAKKLKKISNQAEFIASFYNNDLIKINGELYRVIGVNNDLLNRIEVNMIDITYREYLENINGKRPPQIIKTITSKTQSIKKYSTDILGNLYEVKSKKHPQIIKKG

SEQ ID NO: 1003 - protein, 359 aa, Artificial Sequence
  Description of Artificial Sequence: Synthetic polypeptide
NNGYKHHAEDALIIANADFIFKEWKKLDKAKKVMENQMFEEKQAESMPEIETEQEYKEIFITPHQIKHIKEFKDYKYSHRVDKKPNRKLINDTLYSTRKDDKGNTLIVNNLNGLYDKDNDKLKKLINKSPEKLLMYHHDPQTYQKLKLIMEQYGDEKNPLYKYYEETGIYLTKYSKKDNGPVIKKIKYYGNKLNAHLDITDDYPNSRNKVVKLSLKPYRFDVYLDNGVYKFVTVKNLDVIKKENYYEVNSKCYGEAKKLKKISNQAEFIASFYNNDLIKINGELYRVIGVNNDLLNRIEVNMIDITYREYLEIMNDKRPPQIIKTIASKTQSIKKYSTDILGNLYEVKSNKHPQIIKKG

SEQ ID NO: 1004 - protein, 359 aa, Artificial Sequence
  Description of Artificial Sequence: Synthetic polypeptide
NKGYKHHAEDALIIANADFIFKEWKKLDKAKKVMENQMFEEKQAESMPEIETEQEYKVIFITPHQIKHIKDFKDYKYSHRVDKKPNRKLINDTLYSTRKDDKGNTLIVNNLNGLYDKDNDKLKKLINKSPEKLLMYHHDPQTYQKLKLIMEQYGDEKNPLYIYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPQIIKTIASKTQSIKKYSTDILGNVYEVKSKKHPQIIIKG

SEQ ID NO: 1005 - protein, 359 aa, Artificial Sequence
  Description of Artificial Sequence: Synthetic polypeptide
NKGYKHHAEDALIIANADFIFKEWKKLDKAKKVMENQMFEEKQAESMPEIETGQEYKEIFITPHQIKHIKDFKDYKYSHRVDKKPNRKLINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPQIIKTIASKTQSIKKYSTDILGNLYEVKSKKHPQIIKKG

SEQ ID NO: 1006 - protein, 359 aa, Artificial Sequence
  Description of Artificial Sequence: Synthetic polypeptide
NKGYKHHAEDALIIANADFIFKEWKKLDKSKKVMENQMFEEKQAESMPEIETEQEYKEIFITPHQIKHIKDFKDYKYSHRVDKKHNRKLINDTLYSTRKDDKGNTLIVNNINGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNTIDITYREYLENMNDKRPPQIIKTIASKTQSIKKYSTDILGNLYEVKPKKHPQIIKKG

SEQ ID NO: 1007 - protein, 353 aa, Artificial Sequence
  Description of Artificial Sequence: Synthetic polypeptide
NKGYKHHAEDALIIANADFIFKEWKKLDKAKKVMENQMFEEKQAESMPEIETEQEYKEIFITPHQIKHIKDFKDYKYSHRVDKKPNRKLINDTLYSTREDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDISDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIYITYREYLENMNDKRPPQIIKTIASKTQSIKKYSTDILGNLYEVKSKKHP

SEQ ID NO: 1008 - protein, 359 aa, Artificial Sequence
  Description of Artificial Sequence: Synthetic polypeptide
NKGYKHHAEDALIIANADFIFKEWKKLDKAKKVMENQMFEEKQAESMPEIETEQEYKEIFITPYQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVRNLDVIKKENYYEVNSKCYEEAKKLKKISNQAEFIASFYNNDLIKINGELYRVIGVNNDLLNRIEVNMIDITYREYLENMNDKRPPQIIKTIASKTQSIKKYSTDILGNLYEVKSKKHPQIIKKG

SEQ ID NO: 1009 - protein, 359 aa, Artificial Sequence
  Description of Artificial Sequence: Synthetic polypeptide
NKGYKHHAEDALIIANADFIFKEWKKLDNAKKVMENQMFEEKRAESMPEIETEQEYKEIFITPHQIKHIKDFKDFKYSHMVDKKPNRKLINDTLYSTRKDDKGNTLIVNNLNGLYDKDNDKLKKLINKSPEKLLIYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPQIIKTIASKTQSIKKYSTDILGNLYEVKSKKHPQIIKKG

SEQ ID NO: 1010 - protein, 353 aa, Artificial Sequence
  Description of Artificial Sequence: Synthetic polypeptide
NKGYKHHAEDALIIANADFIFKEWIRLDKAKKVMENQMFEEKQAESMPEIETEQEYKEIFITPHQIKHIKDFKDYKYSHRVDKKPNRKLINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPQIIKTIASKTQSIKKYSTDILGNLYEVKSKKHP

SEQ ID NO: 1011 - protein, 353 aa, Artificial Sequence
  Description of Artificial Sequence: Synthetic polypeptide
NKGYKHHAEDALIVANADFIFKEWKKLDKAKKVMENQMFEEKQAESMPEIETEQEYKEIFITPHQIKHIKDFKDYKYSHRVDKKPNRELINDTLYSTRKDDKGNTLIVINLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPQIIKTIASKTQSIKKYSTDILGNLYEVKSKKHP

SEQ ID NO: 1012 - protein, 353 aa, Artificial Sequence
  Description of Artificial Sequence: Synthetic polypeptide
NKGYKHHAEDALIIANADFIFKEWKKLDKAKKVMENQMFEEKQAESMPEIETEQEYKEIFITPHQIKHIKDFKDYKYSHRVDKKPNRKLINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPQIIKTIASKTQSIKKYSTDILGNLYEVKSKKHP

SEQ ID NO: 1013 - protein, 359 aa, Artificial Sequence
  Description of Artificial Sequence: Synthetic polypeptide
NKGYKHHAEDALIIANADFIFKEWKKLDKAKKVMENQMFEEKQAMSMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPDSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPHIIKTIASKTQSIKKYSTDILGNLYEVKSQKHPQIIKKG

SEQ ID NO: 1014 - protein, 359 aa, Artificial Sequence
  Description of Artificial Sequence: Synthetic polypeptide
NKGYKHHAEDALIIANADFIFKEWKKLDKAKKVMENQMFEEKQAGSMPEIETEQEYKEIFITPHQIKHIKDFKDYKYSHRVDKKPNRKLINDTLYSTRKDDKGNTLIVNNLNRLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLESMNDKRPPQIIKTIASKTQTIKKYSTDILGNLYEVKSKKHPQIIKKG

SEQ ID NO: 1015 - protein, 359 aa, Artificial Sequence
  Description of Artificial Sequence: Synthetic polypeptide
NKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLTNKSPGKLLMYHHDPQTYQKLKLIMEQYGDEKNPLYKYYEETGNYLTKYSKKDNGPVIKKIKYYGNKLNAYLDITDDYPNSRNNVVKLSLKPYRFDVYLDNGVYKFVTVKNLDVIEKENYYEVNSKCYEEAKKLKKISNQAEFIASFYNNDLIKINGELYRVIGVNNDLLNRIEVNMIDITYREYLENMNDKRPPHIIKTIASKTQSIKKYSTDILGNLYEVKSKKHPQIIKKG

SEQ ID NO: 1016 - protein, 359 aa, Artificial Sequence
  Description of Artificial Sequence: Synthetic polypeptide
NKGYKHHAEDALIIANADFIFKEWKKLDKAKKVMENQMFEEKQAESMPEIETEQEYKEIFITPHQIKHIKDFKDYKYSHRVDKKPNRKLINDTLYSTRKDDKGNTLIVNNLNGLYDKDNDKFKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKDNYYEVNSKCYEEAKKLKKISNQAEFIASFYNNDLIKINGELYRVIGVNNDLLNRIEVNMIDITYREYLENMNDKRPPQIIKTIATKTQSIKKYSTDILGNLYEVKSKKHPQIIKKG

SEQ ID NO: 1017 - protein, 357 aa, Artificial Sequence
  Description of Artificial Sequence: Synthetic polypeptide
NKGYKHHAEDALIIANADFIFKEWKKLDKAKKVMENQMFEEKHAESMPEIETEQEYKEIFITPHQIKHIKDFKDYKYSHRVDKKPNRELINDTLYSTRKDDKGNTLIVNNLNGLYDKDNDKLKKLIDKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPQIIKTIASKTQSIKKYSTDILGNLYEVKSKKHPQIIK

SEQ ID NO: 1018 - protein, 359 aa, Artificial Sequence
  Description of Artificial Sequence: Synthetic polypeptide
NKGYKHHAEDALIIANADFIFKEWKKLDKAKKVMENQMFEEKQAESMPEIETEQEYNEIFITPHQIKHIKDFKDYKYSHRVDKKPNRKLINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLYVIKKENYYEVNSKCYEEAKKLKKISNQAEFIASFYNNDLIKINGELYRVIGVNNDLLNRIEVNMIDITYREYLENMNDKRPPQIIKTIASKTQSIKKYSTDILGNLYEVKSKKHPQIIKKG

SEQ ID NO: 1019 - protein, 359 aa, Artificial Sequence
  Description of Artificial Sequence: Synthetic polypeptide
NKGYKHHAEDALIIANADFIFKEWKKLDKAKKVMENQMFEEKQAESMPEIETEQEYKEIFITPHQIKHIKDFKDYKYSHRVDKKPNRKLINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPQIIKTIASKTQSIKKYSTDILGNLYEVKSKKHPQIIKKG

SEQ ID NO: 1020 - DNA, 29 bp, Artificial Sequence
  Description of Artificial Sequence: Synthetic oligonucleotide
  misc_feature (1)..(23): This region may encompass 21-23 nucleotides
  modified_base (1)..(25): a, c, t, g, unknown or other
nnnnnnnnnnnnnnnnnnnnnnnnnarrt

SEQ ID NO: 1021 - DNA, 29 bp, Artificial Sequence
  Description of Artificial Sequence: Synthetic oligonucleotide
  misc_feature (1)..(23): This region may encompass 21-23 nucleotides
  modified_base (1)..(25): a, c, t, g, unknown or other
nnnnnnnnnnnnnnnnnnnnnnnnngrrt

What is claimed is:

1. An isolated variant *Staphylococcus aureus* Cas9 (SaCas9) protein comprising an amino sequence that has at least 95% sequence identity to the amino acid sequence of SEQ ID NO: 2, wherein the amino acid corresponding to E782 of SEQ ID NO: 2, the amino acid corresponding to N968 of SEQ ID NO: 2, and/or the amino acid corresponding to R1015 of SEQ ID NO: 2 is mutated in the variant SaCas9 protein, and wherein the variant SaCas9 protein binds to a guide RNA and a target DNA.

2. The variant SaCas9 protein of claim 1, wherein the amino acid corresponding to E782 is mutated to K, the amino acid corresponding to N968 is mutated to K, and/or the amino acid corresponding to R1015 is mutated to Q or H in the variant SaCas9 protein.

3. The variant SaCas9 protein of claim 1, wherein the amino acid corresponding to E782 is mutated to K, the amino acid corresponding to N968 is mutated to K, and the amino acid corresponding to R1015 is mutated to H in the variant SaCas9, and optionally wherein the amino acid corresponding to E735 of SEQ ID NO: 2 is mutated to K, the amino acid corresponding to K929 of SEQ ID NO: 2 is mutated to R, the amino acid corresponding to A1021 of SEQ ID NO: 2 is mutated to T, or the amino acid corresponding to K1044 of SEQ ID NO: 2 is mutated to N in the variant SaCas9 protein.

4. The variant SaCas9 protein of claim 1, wherein the amino acid corresponding to D10 of SEQ ID NO: 2, the amino acid corresponding to D556 of SEQ ID NO: 2, the amino acid corresponding to H557 of SEQ ID NO: 2, and/or the amino acid corresponding to N580 of SEQ ID NO: 2 is mutated in the variant SaCas9 protein.

5. The variant SaCas9 protein of claim 4, wherein the amino acid corresponding to D10 is mutated to A, the amino acid corresponding to D556 is mutated to A, the amino acid corresponding to H557 is mutated to A, and/or the amino acid corresponding to N580 is mutated to A in the variant SaCas9 protein.

6. The variant SaCas9 protein of claim 4, wherein:
 (i) the amino acid corresponding to D10 is mutated to A and the amino acid corresponding to H557 is mutated to A in the variant SaCas9 protein, or
 (ii) the amino acid corresponding to D10 is mutated to A, the amino acid corresponding to D556 is mutated to A, the amino acid corresponding to H557 is mutated to A, and the amino acid corresponding to N580 is mutated to A in the variant SaCas9 protein.

7. A fusion protein comprising the variant SaCas9 protein of claim 1, fused to a heterologous functional domain, with an optional intervening linker, wherein the linker does not interfere with activity of the fusion protein.

8. The fusion protein of claim 7, wherein the heterologous functional domain is a transcriptional activation domain.

9. The fusion protein of claim 8, wherein the transcriptional activation domain is from VP64 or NF-kB p65.

10. The fusion protein of claim 7, wherein the heterologous functional domain is a transcriptional silencer or transcriptional repression domain.

11. The fusion protein of claim 10, wherein the transcriptional repression domain is a Krueppel-associated box (KRAB) domain, ERF repressor domain (ERD), or mSin3A interaction domain (SID).

12. The fusion protein of claim 10, wherein the transcriptional silencer is Heterochromatin Protein 1 (HP1).

13. The fusion protein of claim 7, wherein the heterologous functional domain is an enzyme that modifies the methylation state of DNA.

14. The fusion protein of claim 13, wherein the enzyme that modifies the methylation state of DNA is a DNA methyltransferase (DNMT) or a Ten-Eleven-Translocation (TET) protein.

15. The fusion protein of claim 14, wherein the TET protein is TET1.

16. The fusion protein of claim 7, wherein the heterologous functional domain is an enzyme that modifies a histone subunit.

17. The fusion protein of claim 16, wherein the enzyme that modifies a histone subunit is a histone acetyltransferase (HAT), histone deacetylase (HDAC), histone methyltransferase (HMT), or histone demethylase.

18. The fusion protein of claim 7, wherein the heterologous functional domain is a biological tether.

19. The fusion protein of claim 18, wherein the biological tether is MS2, Csy4 or lambda N protein.

20. The fusion protein of claim 7, wherein the heterologous functional domain is FokI.

21. A method of altering the genome of an isolated cell, the method comprising contacting the cell with the variant SaCas9 protein of claim 1, and a guide RNA having a region complementary to a selected portion of the genome of the cell, whereby the genome of the cell is altered.

22. The method of claim 21, wherein the variant SaCas9 protein comprises one or more of a nuclear localization sequence, cell penetrating peptide sequence, and/or affinity tag.

23. A method of altering an isolated double stranded DNA (dsDNA) molecule, the method comprising contacting the dsDNA molecule with the variant SaCas9 protein of claim 1, and a guide RNA having a region complementary to a selected portion of the dsDNA molecule, whereby the dsDNA molecule is altered.

24. The variant SaCas9 protein of claim 1, wherein the variant SaCas9 comprises the amino acid sequence of SEQ ID NO: 2, except the amino acid corresponding to E782 of SEQ ID NO: 2, the amino acid corresponding to N968 of SEQ ID NO: 2, and/or the amino acid corresponding to R1015 of SEQ ID NO: 2 is mutated in the variant SaCas9 protein.

* * * * *